United States Patent 11,410,750 (METHYLATION MARKERS AND TARGETED METHYLATION PROBE PANEL) - sequence listing, part 9

SEQ ID NO: 120672 - DNA, 48 bp, Homo sapiens; identical to SEQ ID NO: 88875
  chr21:46130394-46130442
  Hyper

SEQ ID NO: 120673 - DNA, 30 bp, Homo sapiens; identical to SEQ ID NO: 38423
  chr21:46132288-46132318
  Hyper

SEQ ID NO: 120674 - DNA, 170 bp, Homo sapiens; identical to SEQ ID NO: 88877
  chr21:46143057-46143227
  Hyper

SEQ ID NO: 120675 - DNA, 90 bp, Homo sapiens; identical to SEQ ID NO: 88878
  chr21:46143579-46143669
  Hyper

SEQ ID NO: 120676 - DNA, 30 bp, Homo sapiens; identical to SEQ ID NO: 46530
  chr21:46169786-46169816
  Hypo

SEQ ID NO: 120677 - DNA, 62 bp, Homo sapiens; identical to SEQ ID NO: 88880
  chr21:46173291-46173353
  Hypo

SEQ ID NO: 120678 - DNA, 120 bp, Homo sapiens; identical to SEQ ID NO: 88881
  chr21:46183961-46184081
  Hypo

SEQ ID NO: 120679 - DNA, 208 bp, Homo sapiens; identical to SEQ ID NO: 88882
  chr21:46184437-46184645
  Hypo

SEQ ID NO: 120680 - DNA, 30 bp, Homo sapiens; identical to SEQ ID NO: 88883
  chr21:46205669-46205699
  Hypo

SEQ ID NO: 120681 - DNA, 154 bp, Homo sapiens; identical to SEQ ID NO: 88884
  chr21:46206072-46206226
  Hypo

SEQ ID NO: 120682 - DNA, 286 bp, Homo sapiens; identical to SEQ ID NO: 88885
  chr21:46238788-46239074
  Hypo

SEQ ID NO: 120683 - DNA, 41 bp, Homo sapiens; identical to SEQ ID NO: 88886
  chr21:46255003-46255044
  Hypo

SEQ ID NO: 120684 - DNA, 440 bp, Homo sapiens; identical to SEQ ID NO: 88887
  chr21:46256907-46257347
  Hypo

SEQ ID NO: 120685 - DNA, 330 bp, Homo sapiens; identical to SEQ ID NO: 88888
  chr21:46257708-46258038
  Hypo

SEQ ID NO: 120686 - DNA, 30 bp, Homo sapiens; identical to SEQ ID NO: 88889
  chr21:46263121-46263151
  Hypo

SEQ ID NO: 120687 - DNA, 78 bp, Homo sapiens; identical to SEQ ID NO: 46537
  chr21:46273062-46273140
  Hypo

SEQ ID NO: 120688 - DNA, 33 bp, Homo sapiens; identical to SEQ ID NO: 88891
  chr21:46277581-46277614
  Hypo

SEQ ID NO: 120689 - DNA, 979 bp, Homo sapiens; identical to SEQ ID NO: 88892
  chr21:46308425-46309404
  Hypo

SEQ ID NO: 120690 - DNA, 55 bp, Homo sapiens; identical to SEQ ID NO: 88893
  chr21:46309906-46309961
  Hypo

SEQ ID NO: 120691 - DNA, 395 bp, Homo sapiens; identical to SEQ ID NO: 88894
  chr21:46310422-46310817
  Hypo

SEQ ID NO: 120692 - DNA, 149 bp, Homo sapiens; identical to SEQ ID NO: 88895
  chr21:46311753-46311902
  Hypo

SEQ ID NO: 120693 - DNA, 30 bp, Homo sapiens; identical to SEQ ID NO: 88896
  chr21:46313354-46313384
  Hypo

SEQ ID NO: 120694 - DNA, 30 bp, Homo sapiens; identical to SEQ ID NO: 88897
  chr21:46315995-46316025
  Hypo

SEQ ID NO: 120695 - DNA, 222 bp, Homo sapiens; identical to SEQ ID NO: 88898
  chr21:46317030-46317252
  Hypo

SEQ ID NO: 120696 - DNA, 160 bp, Homo sapiens; identical to SEQ ID NO: 88899
  chr21:46318183-46318343
  Hypo

SEQ ID NO: 120697 - DNA, 731 bp, Homo sapiens; identical to SEQ ID NO: 88900
  chr21:46318774-46319505
  Hypo

SEQ ID NO: 120698 - DNA, 135 bp, Homo sapiens; identical to SEQ ID NO: 88901
  chr21:46321513-46321648
  Hypo

SEQ ID NO: 120699 - DNA, 30 bp, Homo sapiens; identical to SEQ ID NO: 88902
  chr21:46329001-46329031
  Hypo

SEQ ID NO: 120700 - DNA, 124 bp, Homo sapiens; identical to SEQ ID NO: 88903
  chr21:46351313-46351437
  Hyper

SEQ ID NO: 120701 - DNA, 626 bp, Homo sapiens; identical to SEQ ID NO: 88904
  chr21:46351653-46352279
  Hyper

SEQ ID NO: 120702 - DNA, 195 bp, Homo sapiens; identical to SEQ ID NO: 88905
  chr21:46352673-46352868
  Hyper

SEQ ID NO: 120703 - DNA, 340 bp, Homo sapiens; identical to SEQ ID NO: 88906
  chr21:46359019-46359359
  Hypo

SEQ ID NO: 120704 - DNA, 55 bp, Homo sapiens; identical to SEQ ID NO: 88907
  chr21:46402502-46402557
  Hypo

SEQ ID NO: 120705 - DNA, 60 bp, Homo sapiens; identical to SEQ ID NO: 88908
  chr21:46424460-46424520
  Hypo

SEQ ID NO: 120706 - DNA, 30 bp, Homo sapiens; identical to SEQ ID NO: 88909
  chr21:46424927-46424957
  Hypo

SEQ ID NO: 120707 - DNA, 65 bp, Homo sapiens; identical to SEQ ID NO: 46549
  chr21:46431841-46431906
  Hypo

SEQ ID NO: 120708 - DNA, 897 bp, Homo sapiens
  chr21:46438210-46439107
  Hyper
acccccgccctcagccgttcgtgcacttggtccaggcgggacccggcaggacccccagcagccccgggaagcgcccggacgacggcacgggggccccagggcgccgcgaaggaagccccccgagggcgaggccgggcgaggccagggggccggggccagaggcggtcgcggcgggggtgggtgtcctggagcaggagcggcagcgggaaacgaagacacgcgcttcttcctactggggggatggctgggaagtaagaccggccgggccgccgagcccgctgcgaggggcttcgcgtggcggccgcacctgagcccgagcgcgcccttgagaggcggcgcccacgggggcagagacccacggtccacgcgcagacccggagaacccgcgatgtcgccgcacgcagcgccgctgtgaaggacggaggcggggcggggccctgggacagggagcgggtgggggcggggtggggggagggcccgtccgggcctgcgcgggaagccctgggttggccttggtgctctgtgatgcccacgctgggtgcaaatgttgctttggtaaaaataacaacaacgaaaggaaaagccaagccggaccagccccacccgcagggccccggccccggccccggccccgcccttggactcttccccgccccacccccacccgtgggcgagcgagcccggaccgtgaagggagggggcggggcgggggcccggaggggcggggaggggccgggtcctcccgcgcggggtcctggaggtcgcggcacgcgctccctgcaggcgaccctggggcgcgtctgtcccaggcccgggcaggacccccgcccgctggttgtctgcgcggctgccccgcgcccgccgcccccggccgctgtcgcgcgttcccagacattc

SEQ ID NO: 120709 - DNA, 73 bp, Homo sapiens; identical to SEQ ID NO: 88913
  chr21:46439283-46439356
  Hypo

SEQ ID NO: 120710 - DNA, 30 bp, Homo sapiens; identical to SEQ ID NO: 88914
  chr21:46441167-46441197
  Hypo

SEQ ID NO: 120711 - DNA, 356 bp, Homo sapiens; identical to SEQ ID NO: 88915
  chr21:46452216-46452572
  Hypo

SEQ ID NO: 120712 - DNA, 30 bp, Homo sapiens; identical to SEQ ID NO: 88916
  chr21:46462910-46462940
  Hypo

SEQ ID NO: 120713 - DNA, 124 bp, Homo sapiens; identical to SEQ ID NO: 88917
  chr21:46492315-46492439
  Hypo

SEQ ID NO: 120714 - DNA, 41 bp, Homo sapiens; identical to SEQ ID NO: 88918
  chr21:46495431-46495472
  Hyper

SEQ ID NO: 120715 - DNA, 34 bp, Homo sapiens; identical to SEQ ID NO: 46552
  chr21:46549475-46549509
  Hypo

SEQ ID NO: 120716 - DNA, 159 bp, Homo sapiens; identical to SEQ ID NO: 88920
  chr21:46677734-46677893
  Hypo

SEQ ID NO: 120717 - DNA, 67 bp, Homo sapiens; identical to SEQ ID NO: 88921
  chr21:46678745-46678812
  Hypo

SEQ ID NO: 120718 - DNA, 217 bp, Homo sapiens
  chr21:46706791-46707008
  Hyper
cccacagccacagggcggccgcgaagctcgtcttggccctgagaattcactgcggagcgcccgcccggcactgactcccggctccgcacacccaggcctggacccgtgtcacttgcaggggcctccggagccagcccacgctcagcctgagcaacccggcccccttcctgggctcccgaggctgcgccccgggcctcgcagacgaccccgcctgcag

SEQ ID NO: 120719 - DNA, 37 bp, Homo sapiens; identical to SEQ ID NO: 88923
  chr21:46713325-46713362
  Hypo

SEQ ID NO: 120720 - DNA, 30 bp, Homo sapiens; identical to SEQ ID NO: 88924
  chr21:46723304-46723334
  Hypo

SEQ ID NO: 120721 - DNA, 30 bp, Homo sapiens; identical to SEQ ID NO: 88925
  chr21:46754541-46754571
  Hypo

SEQ ID NO: 120722 - DNA, 30 bp, Homo sapiens; identical to SEQ ID NO: 88926
  chr21:46764430-46764460
  Hypo

SEQ ID NO: 120723 - DNA, 167 bp, Homo sapiens; identical to SEQ ID NO: 88927
  chr21:46765675-46765842
  Hypo

SEQ ID NO: 120724 - DNA, 59 bp, Homo sapiens; identical to SEQ ID NO: 88928
  chr21:46766071-46766130
  Hypo

SEQ ID NO: 120725 - DNA, 30 bp, Homo sapiens; identical to SEQ ID NO: 88929
  chr21:46785365-46785395
  Hypo

SEQ ID NO: 120726 - DNA, 102 bp, Homo sapiens; identical to SEQ ID NO: 88930
  chr21:46790661-46790763
  Hypo

SEQ ID NO: 120727 - DNA, 30 bp, Homo sapiens; identical to SEQ ID NO: 88931
  chr21:46800750-46800780
  Hypo

SEQ ID NO: 120728 - DNA, 30 bp, Homo sapiens; identical to SEQ ID NO: 88932
  chr21:46804073-46804103
  Hypo

SEQ ID NO: 120729 - DNA, 64 bp, Homo sapiens; identical to SEQ ID NO: 88933
  chr21:46804718-46804782
  Hypo

SEQ ID NO: 120730 - DNA, 70 bp, Homo sapiens; identical to SEQ ID NO: 88934
  chr21:46805792-46805862
  Hypo

SEQ ID NO: 120731 - DNA, 30 bp, Homo sapiens; identical to SEQ ID NO: 88935
  chr21:46808834-46808864
  Hypo

SEQ ID NO: 120732 - DNA, 30 bp, Homo sapiens; identical to SEQ ID NO: 88936
  chr21:46813076-46813106
  Hypo

SEQ ID NO: 120733 - DNA, 30 bp, Homo sapiens; identical to SEQ ID NO: 88937
  chr21:46822823-46822853
  Hypo

SEQ ID NO: 120734 - DNA, 597 bp, Homo sapiens; identical to SEQ ID NO: 88938
  chr21:46825134-46825731
  Hyper

SEQ ID NO: 120735 - DNA, 210 bp, Homo sapiens; identical to SEQ ID NO: 88939
  chr21:46839039-46839249
  Hypo

SEQ ID NO: 120736 - DNA, 135 bp, Homo sapiens; identical to SEQ ID NO: 88940
  chr21:46844628-46844763
  Hypo

SEQ ID NO: 120737 - DNA, 32 bp, Homo sapiens; identical to SEQ ID NO: 88941
  chr21:46845211-46845243
  Hypo

SEQ ID NO: 120738 - DNA, 30 bp, Homo sapiens; identical to SEQ ID NO: 88942
  chr21:46846999-46847029
  Hypo

SEQ ID NO: 120739 - DNA, 79 bp, Homo sapiens
  chr21:46847351-46847430
  Hypo
tcaggcctcttgacccgcctggcactgaccagactgtgtgcccgggtgccgtgcccatgggctccgcctcccccaggca

SEQ ID NO: 120740 - DNA, 153 bp, Homo sapiens
  chr21:46848052-46848205
  Hypo
gtgcaggttggggtccggcgctcctgcaggcaggcggcgtctgggcctgggggctctcagagtttgaggagcgtgtggtgagggtggcctcgggcctcaaagacgcagcgctgtgggaaccgggagactggctgagcccgctctgaggaaggt

SEQ ID NO: 120741 - DNA, 190 bp, Homo sapiens; identical to SEQ ID NO: 88944
  chr21:46848572-46848762
  Hypo

SEQ ID NO: 120742 - DNA, 188 bp, Homo sapiens; identical to SEQ ID NO: 88945
  chr21:46853309-46853497
  Hypo

SEQ ID NO: 120743 - DNA, 49 bp, Homo sapiens; identical to SEQ ID NO: 88946
  chr21:46854204-46854253
  Hypo

SEQ ID NO: 120744 - DNA, 30 bp, Homo sapiens; identical to SEQ ID NO: 88947
  chr21:46855623-46855653
  Hypo

SEQ ID NO: 120745 - DNA, 139 bp, Homo sapiens; identical to SEQ ID NO: 88948
  chr21:46859943-46860082
  Hypo

SEQ ID NO: 120746 - DNA, 83 bp, Homo sapiens; identical to SEQ ID NO: 46558
  chr21:46863752-46863835
  Hypo

SEQ ID NO: 120747 - DNA, 321 bp, Homo sapiens; identical to SEQ ID NO: 88950
  chr21:46864130-46864451
  Hypo

SEQ ID NO: 120748 - DNA, 139 bp, Homo sapiens; identical to SEQ ID NO: 88951
  chr21:46894771-46894910
  Hypo

SEQ ID NO: 120749 - DNA, 324 bp, Homo sapiens; identical to SEQ ID NO: 88952
  chr21:46895167-46895491
  Hypo

SEQ ID NO: 120750 - DNA, 30 bp, Homo sapiens; identical to SEQ ID NO: 88953
  chr21:46895706-46895736
  Hypo

SEQ ID NO: 120751 - DNA, 47 bp, Homo sapiens; identical to SEQ ID NO: 88954
  chr21:46901324-46901371
  Hypo

SEQ ID NO: 120752 - DNA, 644 bp, Homo sapiens; identical to SEQ ID NO: 88955
  chr21:46908900-46909544
  Hypo

SEQ ID NO: 120753 - DNA, 471 bp, Homo sapiens; identical to SEQ ID NO: 88956
  chr21:46912057-46912528
  Hypo

SEQ ID NO: 120754 - DNA, 77 bp, Homo sapiens; identical to SEQ ID NO: 88957
  chr21:46913283-46913360
  Hypo

SEQ ID NO: 120755 - DNA, 30 bp, Homo sapiens; identical to SEQ ID NO: 88958
  chr21:46919113-46919143
  Hypo

SEQ ID NO: 120756 - DNA, 163 bp, Homo sapiens; identical to SEQ ID NO: 46566
  chr21:46921470-46921633
  Hypo

SEQ ID NO: 120757 - DNA, 30 bp, Homo sapiens; identical to SEQ ID NO: 88960
  chr21:46921992-46922022
  Hypo

SEQ ID NO: 120758 - DNA, 583 bp, Homo sapiens; identical to SEQ ID NO: 88961
  chr21:46925317-46925900
  Hypo

SEQ ID NO: 120759 - DNA, 145 bp, Homo sapiens; identical to SEQ ID NO: 46569
  chr21:46926439-46926584
  Hypo

SEQ ID NO: 120760 - DNA, 89 bp, Homo sapiens; identical to SEQ ID NO: 46570
  chr21:46934071-46934160
  Hypo

SEQ ID NO: 120761 - DNA, 154 bp, Homo sapiens; identical to SEQ ID NO: 88964
  chr21:46935829-46935983
  Hypo

SEQ ID NO: 120762 - DNA, 157 bp, Homo sapiens; identical to SEQ ID NO: 88965
  chr21:46946883-46947040
  Hypo

SEQ ID NO: 120763 - DNA, 41 bp, Homo sapiens; identical to SEQ ID NO: 88966
  chr21:46961319-46961360
  Hypo

SEQ ID NO: 120764 - DNA, 43 bp, Homo sapiens; identical to SEQ ID NO: 88967
  chr21:46978498-46978541
  Hypo

SEQ ID NO: 120765 - DNA, 117 bp, Homo sapiens; identical to SEQ ID NO: 88968
  chr21:46998723-46998840
  Hypo

SEQ ID NO: 120766 - DNA, 40 bp, Homo sapiens; identical to SEQ ID NO: 88969
  chr21:46999819-46999859
  Hypo

SEQ ID NO: 120767 - DNA, 692 bp, Homo sapiens
  chr21:47010090-47010782
  Hyper
aaaaagtcctccttccgtttcccgcactggtaggaaagctggggagagagaaggagtctcaccgtcctggaccagtcggaaccacagaggccgctccgggtccgggggcgacttccgagtgggggaaggaggccggagggcgcgcggccgagcccagacccagcagagcgcgcggccgcccgctcccaggtttccctccatctcggccccggccgcctctgaggttctggaccaagcccagtgcccgctgcccgcagaaggcctcactctggagccggcggggagggcggggacgcggctgtccagagctccgtgcccgccccgggagttcgaagggtgctggggccgaggggaaggctctggtcggcggcgtcagcggcagctcccagacgacctaggactgcaaagggcccaggacggggggcggggcggagacaggaggcggggcggaggcatgggggcggagacatgaaggggcggggctggggcggggctgaggcaggaggggcggggctgaggcaggaggggcggggctgaggcaggaggggcggggcagagcctgagacaccccgccccgccccccacctccacctcgagcccgcccctctcccaggctcctgctccagggcgaacccgggggtcctctcccatggctctgtgggggaccccggggaggtcgccctggcacggga

SEQ ID NO: 120768 - DNA, 77 bp, Homo sapiens; identical to SEQ ID NO: 46574
  chr21:47013235-47013312
  Hypo

SEQ ID NO: 120769 - DNA, 156 bp, Homo sapiens; identical to SEQ ID NO: 88973
  chr21:47019157-47019313
  Hypo

SEQ ID NO: 120770 - DNA, 33 bp, Homo sapiens; identical to SEQ ID NO: 88974
  chr21:47026246-47026279
  Hypo

SEQ ID NO: 120771 - DNA, 420 bp, Homo sapiens; identical to SEQ ID NO: 88975
  chr21:47026399-47026819
  Hypo

SEQ ID NO: 120772 - DNA, 160 bp, Homo sapiens; identical to SEQ ID NO: 88976
  chr21:47027910-47028070
  Hypo

SEQ ID NO: 120773 - DNA, 16 bp, Homo sapiens
  chr21:47034414-47034430
  Hypo
gcgtgagccaccgtgc

SEQ ID NO: 120774 - DNA, 30 bp, Homo sapiens; identical to SEQ ID NO: 88978
  chr21:47034932-47034962
  Hypo

SEQ ID NO: 120775 - DNA, 96 bp, Homo sapiens; identical to SEQ ID NO: 88979
  chr21:47036030-47036126
  Hypo

SEQ ID NO: 120776 - DNA, 83 bp, Homo sapiens; identical to SEQ ID NO: 88980
  chr21:47036475-47036558
  Hypo

SEQ ID NO: 120777 - DNA, 517 bp, Homo sapiens
  chr21:47062381-47062898
  Hyper
gaaacggggcccaggcgcggcgactgcggaggacgcgcctcggccccagcgccctggtcctcggggcgtccggctgcccttgcccgaggccggggcgggcgctcagcgccgcggaagaaacgcccgggcggggacgcacagcgaggcgggctccgcgggaagtaccgggaaaacggcgcggagcggaacagcccggagccagcccagagaaagggcggcctccccctgcagcccccggggcccagcaacgccccgccccaggccacggcacgcgaacgccgggcgggcggaggggacagggcggcgggaccagcgcggggcgggcagcgtctgggcacaggctcacgagccgctcggggcccctgcccgccgggcgctgcggccccagcctccgggccggggccaggcccacagagaacgggaagcgggcgctgcagggggaccttcggggttgcggcacggctgggaattcaacggccattcccgtcccgtcgggcccacccgcccgcccgccaaa

SEQ ID NO: 120778 - DNA, 1044 bp, Homo sapiens; identical to SEQ ID NO: 88982
  chr21:47063432-47064476
  Hyper

SEQ ID NO: 120779 - DNA, 30 bp, Homo sapiens; identical to SEQ ID NO: 88983
  chr21:47167443-47167473
  Hypo

SEQ ID NO: 120780 - DNA, 30 bp, Homo sapiens; identical to SEQ ID NO: 88984
  chr21:47168125-47168155
  Hypo

SEQ ID NO: 120781 - DNA, 151 bp, Homo sapiens; identical to SEQ ID NO: 88985
  chr21:47181649-47181800
  Hypo

SEQ ID NO: 120782 - DNA, 30 bp, Homo sapiens; identical to SEQ ID NO: 88986
  chr21:47189452-47189482
  Hypo

SEQ ID NO: 120783 - DNA, 131 bp, Homo sapiens; identical to SEQ ID NO: 88987
  chr21:47213449-47213580
  Hypo

SEQ ID NO: 120784 - DNA, 30 bp, Homo sapiens; identical to SEQ ID NO: 88988
  chr21:47254735-47254765
  Hypo

SEQ ID NO: 120785 - DNA, 30 bp, Homo sapiens; identical to SEQ ID NO: 88989
  chr21:47283366-47283396
  Hypo

SEQ ID NO: 120786 - DNA, 413 bp, Homo sapiens; identical to SEQ ID NO: 88990
  chr21:47287026-47287439
  Hypo

SEQ ID NO: 120787 - DNA, 30 bp, Homo sapiens; identical to SEQ ID NO: 88991
  chr21:47295773-47295803
  Hypo

SEQ ID NO: 120788 - DNA, 30 bp, Homo sapiens; identical to SEQ ID NO: 88992
  chr21:47320229-47320259
  Hypo

SEQ ID NO: 120789 - DNA, 242 bp, Homo sapiens; identical to SEQ ID NO: 88993
  chr21:47328400-47328642
  Hypo

SEQ ID NO: 120790 - DNA, 30 bp, Homo sapiens; identical to SEQ ID NO: 88994
  chr21:47329348-47329378
  Hypo

SEQ ID NO: 120791 - DNA, 47 bp, Homo sapiens; identical to SEQ ID NO: 88995
  chr21:47333573-47333620
  Hypo

SEQ ID NO: 120792 - DNA, 43 bp, Homo sapiens; identical to SEQ ID NO: 88996
  chr21:47365144-47365187
  Hypo

SEQ ID NO: 120793 - DNA, 295 bp, Homo sapiens; identical to SEQ ID NO: 88997
  chr21:47365639-47365934
  Hypo

SEQ ID NO: 120794 - DNA, 157 bp, Homo sapiens; identical to SEQ ID NO: 88998
  chr21:47369368-47369525
  Hypo

SEQ ID NO: 120795 - DNA, 440 bp, Homo sapiens
  chr21:47392685-47393125
  Hyper
ctgagctgtgccactcgtgcagccctggccctccgcagcctcggcaaccccacccgagggctcccactgctgcccacagacatctcagggtctcccgggccgggtcagcggcgccggaacagggtctcccgggccgggtcagcggcgccggaagtgattctcgtcagcaggaatgcgctggctgcccgggagccttcagggtgggctctgggggccaggtgcggcctcagcgccgtcccttcccgggaagcctcctccctggggtccacgccggctcctgctggctcccccattccgctgaaatctgaggaaaaggctctgggaacgcagccagactcccccacagctcagacggctgtaaagaaatattcctgccagatgttcagaggcggaggccagcatgaggtaacgggaaaggcttaacccgtccagccccgcag

SEQ ID NO: 120796 - DNA, 42 bp, Homo sapiens; identical to SEQ ID NO: 89000
  chr21:47393499-47393541
  Hyper

SEQ ID NO: 120797 - DNA, 222 bp, Homo sapiens; identical to SEQ ID NO: 89001
  chr21:47393601-47393823
  Hyper

SEQ ID NO: 120798 - DNA, 30 bp, Homo sapiens; identical to SEQ ID NO: 89002
  chr21:47394641-47394671
  Hyper

SEQ ID NO: 120799 - DNA, 99 bp, Homo sapiens; identical to SEQ ID NO: 89003
  chr21:47401911-47402010
  Hyper

SEQ ID NO: 120800 - DNA, 333 bp, Homo sapiens; identical to SEQ ID NO: 89004
  chr21:47403992-47404325
  Hypo

SEQ ID NO: 120801 - DNA, 30 bp, Homo sapiens; identical to SEQ ID NO: 89005
  chr21:47407032-47407062
  Hypo

SEQ ID NO: 120802 - DNA, 32 bp, Homo sapiens; identical to SEQ ID NO: 89006
  chr21:47414295-47414327
  Hypo

SEQ ID NO: 120803 - DNA, 349 bp, Homo sapiens; identical to SEQ ID NO: 89007
  chr21:47417760-47418109
  Hypo

SEQ ID NO: 120804 - DNA, 49 bp, Homo sapiens; identical to SEQ ID NO: 89008
  chr21:47418439-47418488
  Hypo

SEQ ID NO: 120805 - DNA, 144 bp, Homo sapiens; identical to SEQ ID NO: 89009
  chr21:47420442-47420586
  Hypo

SEQ ID NO: 120806 - DNA, 252 bp, Homo sapiens; identical to SEQ ID NO: 89010
  chr21:47421120-47421372
  Hypo

SEQ ID NO: 120807 - DNA, 30 bp, Homo sapiens; identical to SEQ ID NO: 89011
  chr21:47421881-47421911
  Hypo

SEQ ID NO: 120808 - DNA, 515 bp, Homo sapiens; identical to SEQ ID NO: 89012
  chr21:47422662-47423177
  Hypo

SEQ ID NO: 120809 - DNA, 30 bp, Homo sapiens; identical to SEQ ID NO: 89013
  chr21:47423396-47423426
  Hypo

SEQ ID NO: 120810 - DNA, 327 bp, Homo sapiens; identical to SEQ ID NO: 89014
  chr21:47425521-47425848
  Hypo

SEQ ID NO: 120811 - DNA, 286 bp, Homo sapiens; identical to SEQ ID NO: 89015
  chr21:47426447-47426733
  Hypo

SEQ ID NO: 120812 - DNA, 73 bp, Homo sapiens; identical to SEQ ID NO: 89016
  chr21:47430142-47430215
  Hypo

SEQ ID NO: 120813 - DNA, 30 bp, Homo sapiens; identical to SEQ ID NO: 89017
  chr21:47442780-47442810
  Hypo

SEQ ID NO: 120814 - DNA, 65 bp, Homo sapiens; identical to SEQ ID NO: 89018
  chr21:47452998-47453063
  Hypo

SEQ ID NO: 120815 - DNA, 44 bp, Homo sapiens; identical to SEQ ID NO: 89019
  chr21:47457144-47457188
  Hypo

SEQ ID NO: 120816 - DNA, 72 bp, Homo sapiens; identical to SEQ ID NO: 89020
  chr21:47457442-47457514
  Hypo

SEQ ID NO: 120817 - DNA, 30 bp, Homo sapiens; identical to SEQ ID NO: 89021
  chr21:47457793-47457823
  Hypo

SEQ ID NO: 120818 - DNA, 35 bp, Homo sapiens; identical to SEQ ID NO: 46592
  chr21:47459822-47459857
  Hypo

SEQ ID NO: 120819 - DNA, 149 bp, Homo sapiens; identical to SEQ ID NO: 89023
  chr21:47461082-47461231
  Hypo

SEQ ID NO: 120820 - DNA, 53 bp, Homo sapiens; identical to SEQ ID NO: 89024
  chr21:47470121-47470174
  Hypo

SEQ ID NO: 120821 - DNA, 65 bp, Homo sapiens; identical to SEQ ID NO: 46593
  chr21:47471074-47471139
  Hypo

SEQ ID NO: 120822 - DNA, 30 bp, Homo sapiens; identical to SEQ ID NO: 89026
  chr21:47472379-47472409
  Hypo

SEQ ID NO: 120823 - DNA, 133 bp, Homo sapiens; identical to SEQ ID NO: 89027
  chr21:47475230-47475363
  Hypo

SEQ ID NO: 120824 - DNA, 289 bp, Homo sapiens; identical to SEQ ID NO: 89028
  chr21:47487537-47487826
  Hypo

SEQ ID NO: 120825 - DNA, 153 bp, Homo sapiens; identical to SEQ ID NO: 89029
  chr21:47489936-47490089
  Hypo

SEQ ID NO: 120826 - DNA, 40 bp, Homo sapiens; identical to SEQ ID NO: 89030
  chr21:47501864-47501904
  Hypo

SEQ ID NO: 120827 - DNA, 34 bp, Homo sapiens; identical to SEQ ID NO: 16748
  chr21:47503061-47503095
  Hypo

SEQ ID NO: 120828 - DNA, 43 bp, Homo sapiens; identical to SEQ ID NO: 89032
  chr21:47504852-47504895
  Hypo

SEQ ID NO: 120829 - DNA, 1306 bp, Homo sapiens
  chr21:47517762-47519068
  Hyper
acgggcggccgggcccgggacgcgaagtccgagcagcagcgggcaggggctggcgggggagctcggcccgggctgcaggggggtccccaccctctccacctcctccagcctcccgccctcgagggtccccgcttccctcccatccccctcccgtgcccccggccccctcctcccatccgcggggccgcagcgcttcctggcggcggggcgggtcaggccggcggggcggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcgcgacttggggccacctccccgcggcctcctctggggcggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggtgatta

SEQ ID NO: 120830 - DNA, 212 bp, Homo sapiens; identical to SEQ ID NO: 89036
  chr21:47531922-47532134
  Hypo

SEQ ID NO: 120831 - DNA, 184 bp, Homo sapiens; identical to SEQ ID NO: 89037
  chr21:47537583-47537767
  Hypo

SEQ ID NO: 120832 - DNA, 192 bp, Homo sapiens; identical to SEQ ID NO: 89038
  chr21:47538699-47538891
  Hypo

SEQ ID NO: 120833 - DNA, 36 bp, Homo sapiens; identical to SEQ ID NO: 89039
  chr21:47539603-47539639
  Hypo

SEQ ID NO: 120834 - DNA, 128 bp, Homo sapiens; identical to SEQ ID NO: 89040
  chr21:47545946-47546074
  Hypo

SEQ ID NO: 120835 - DNA, 155 bp, Homo sapiens; identical to SEQ ID NO: 89041
  chr21:47548588-47548743
  Hypo

SEQ ID NO: 120836 - DNA, 94 bp, Homo sapiens; identical to SEQ ID NO: 89042
  chr21:47565176-47565270
  Hypo

SEQ ID NO: 120837 - DNA, 109 bp, Homo sapiens; identical to SEQ ID NO: 89043
  chr21:47570249-47570358
  Hypo

SEQ ID NO: 120838 - DNA, 246 bp, Homo sapiens; identical to SEQ ID NO: 89044
  chr21:47602459-47602705
  Hypo

SEQ ID NO: 120839 - DNA, 62 bp, Homo sapiens; identical to SEQ ID NO: 89045
  chr21:47689638-47689700
  Hypo

SEQ ID NO: 120840 - DNA, 238 bp, Homo sapiens
  chr21:47717212-47717450
  Hyper
ctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccagcgcgcttccttccttcc

SEQ ID NO: 120841 - DNA, 30 bp, Homo sapiens
  chr21:47717697-47717727
  Hyper
aaaacggttccgagccgtggcatcgagagg

SEQ ID NO: 120842 - DNA, 70 bp, Homo sapiens; identical to SEQ ID NO: 89048
  chr21:47737895-47737965
  Hypo

SEQ ID NO: 120843 - DNA, 300 bp, Homo sapiens; identical to SEQ ID NO: 89049
  chr21:47746178-47746478
  Hypo

SEQ ID NO: 120844 - DNA, 349 bp, Homo sapiens; identical to SEQ ID NO: 89050
  chr21:47771760-47772109
  Hypo

SEQ ID NO: 120845 - DNA, 30 bp, Homo sapiens; identical to SEQ ID NO: 89051
  chr21:47798788-47798818
  Hypo

SEQ ID NO: 120846 - DNA, 44 bp, Homo sapiens; identical to SEQ ID NO: 46610
  chr21:47799181-47799225
  Hypo

SEQ ID NO: 120847 - DNA, 58 bp, Homo sapiens; identical to SEQ ID NO: 89053
  chr21:47799808-47799866
  Hypo

SEQ ID NO: 120848 - DNA, 30 bp, Homo sapiens; identical to SEQ ID NO: 89054
  chr21:47808338-47808368
  Hypo

SEQ ID NO: 120849 - DNA, 33 bp, Homo sapiens; identical to SEQ ID NO: 89055
  chr21:47813009-47813042
  Hypo

SEQ ID NO: 120850 - DNA, 30 bp, Homo sapiens; identical to SEQ ID NO: 89056
  chr21:48068622-48068652
  Hypo

SEQ ID NO: 120851 - DNA, 1088 bp, Homo sapiens; identical to SEQ ID NO: 89057
  chr21:48087199-48088287
  Hyper

SEQ ID NO: 120852 - DNA, 30 bp, Homo sapiens; identical to SEQ ID NO: 89058
  chr22:17076404-17076434
  Hypo

SEQ ID NO: 120853 - DNA, 1664 bp, Homo sapiens
  chr22:17081893-17083557
  Hyper
ggcgttggattagaacgaagttgactccattccttttcctccccgtagtgtgggcgatacgaggaaagacctcggcaagaaccagcgaagccccggctgccctcgccctgcgggcgcacacttgctcctcgcgccgggctgcgccgggcgcccgcgccgcctcggcgtgtgtccgcggctccctcccgccctcgcccgcagtcccccgatcccgatcccggatctctgggtccacagcttggctccctcccgagccggagccggagccggagccgaagtcgcggctgggcccggccgccccgtcacagggggagggaacccatggggagggggaggggcggtgaggtcagcggcggcggcgcgtccgcgggcggcgggagcttcgcatgcgcggagcgaggcccgtgagtggcagcggcggcgcgcggggggcgggcgaggggccgagagtgggggagcgggcgggggccgtcgaggaggcgttgtgtgggcgcgacggctgcgagttggggaggtctgtggtgcgggtcgccccgggggatccccggcgcgggcctcgcgcgacggccacggtcgcgcggcgtgtgtggggggtccacgcacacccgcaaaacttcctcctcccctgctccgggagagcgagcgagcgtgtgtgagagcgagtgtgaggagcgagccgcggcccgacgcccagcgccgccgctggagcagctgtcaaaacttcgccgccgcccgggccccgcggcccgccctccccgcgccgggcccctttctcttcctgctgcgggcggcccgggggaggggccgcgggcggagaccccggaggccggcgcccctcacgccgcccgcccgcccgctccccgcccggcccctgcgcgcgtgcgtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaagtaagttgagtgcgagggagccaggccgggagccagcggcggcgccgggccggagctgccaccgggcgcccgccccgcggcctccacgccttggcgccccccggcgggatgggggcggggcgggcccgcgggcggcggcagctcccggccccggccccacgcccctcggtagccgcccgcgcccggcctcccccgctccgcgccgcccgcccgggctcccgtcggcgcccggcttcgcacactttacttttcagtcgggccttttcagtgggtcttctccgcgactcttcttttggagaaatttctcgtagccgcgtcttggcctagctggatcattgagaaaacaagcccggagcgcgcgcaggtagtccccggacggactccgagcgaaccgccgagccgtgggcgctcgggaaactcggagctgtcaaaacgcccgggccaggtggtct

SEQ ID NO: 120854 - DNA, 287 bp, Homo sapiens
  chr22:17083805-17084092
  Hyper
tagccagcgtcccctcgtaaggcagaataccaagagcacttattcagagagagtgcagatgtaaatgtcgtttccctcgtaagtcttagctgtaaggggcttgggaatagggtcgcctgcctttgaccgaccgtactgtagggctggacaccggcttattagaggaccagaaatgtcttcttacagaacggttatttgacggctttgcttgtaaattaagacaccgttttagtgccagcgagctgctcggcttctgtggctctcgcgtgtgccgtggaagaactgtg

SEQ ID NO: 120855 - DNA, 216 bp, Homo sapiens
  chr22:17090649-17090865
  Hyper
ccgacgtcccccctccgcccgcgccccaagggctgactgggcaaattggcagatccgccccgcggggcgacccaacttttcggaacagccccccaccgcccacccctgcagatccccggacccccgctcccggcggagattcagggaaccccgcatcccaagcccttctaaatcgtgcggcctgagtgtgacggccaagagcggatgcagcccggg

SEQ ID NO: 120856 - DNA, 79 bp, Homo sapiens; identical to SEQ ID NO: 89068
  chr22:17129959-17130038
  Hypo

SEQ ID NO: 120857 - DNA, 37 bp, Homo sapiens; identical to SEQ ID NO: 46611
  chr22:17330739-17330776
  Hypo

SEQ ID NO: 120858 - DNA, 37 bp, Homo sapiens; identical to SEQ ID NO: 89070
  chr22:17489436-17489473
  Hypo

SEQ ID NO: 120859 - DNA, 562 bp, Homo sapiens
  chr22:17600944-17601506
  Hyper
agcgccatggtgagacggaagcccgtggtgccgaagggcgcgcgtagctcgatgaggtctaggatggacgtgcccaggatcagcaccaccttgggagtgaaggcgatggagtagataagccaggccaggtaggcgaaggcgaactcgcccgctgccgcggccgcccccaggccgccccccgcgccgccggcgcccccgcgggctccgcgtgccttggccccagcggtagcggccgagggggcgggcagatgcaggggcggcgcggcgtggtggtggtgcaggtggtggttgtgcgcgccgctggctgcgccgccccgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcaccacggacagcgcctggtagccccagcggcacctgggactgggggcgcagccgcggcgccgacctctgcggccggggcggtctgggcagccgcagcagcagcaac

SEQ ID NO: 120860 - DNA, 71 bp, Homo sapiens; identical to SEQ ID NO: 89073
  chr22:17601956-17602027
  Hyper

SEQ ID NO: 120861 - DNA, 321 bp, Homo sapiens; identical to SEQ ID NO: 89074
  chr22:17602324-17602645
  Hyper

SEQ ID NO: 120862 - DNA, 465 bp, Homo sapiens
  chr22:17849412-17849877
  Hyper
ttagcagtactccaccgcgctacagcagttagcatttctaaagcacacactccaacacccttcggccgtagcacattcaatccctccgccggggcgtgggggtctcctcccctccgagcacagtccccggcttcccgatttcctctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctccatcctacttcgttccagctcaatcagccccaccgccttcttccctcggagaaaaaagccacttcagagctccttgggcgccgttctcggctggaataaaagcgttaagaaacaggt

SEQ ID NO: 120863 - DNA, 1039 bp, Homo sapiens; identical to SEQ ID NO: 89077
  chr22:17850114-17851153
  Hyper

SEQ ID NO: 120864 - DNA, 120 bp, Homo sapiens; identical to SEQ ID NO: 46612
  chr22:18009965-18010085
  Hypo

SEQ ID NO: 120865 - DNA, 97 bp, Homo sapiens; identical to SEQ ID NO: 46613
  chr22:18110592-18110689
  Hypo

SEQ ID NO: 120866 - DNA, 47 bp, Homo sapiens; identical to SEQ ID NO: 89080
  chr22:18265476-18265523
  Hypo

SEQ ID NO: 120867 - DNA, 30 bp, Homo sapiens; identical to SEQ ID NO: 46614
  chr22:18265801-18265831
  Hypo

SEQ ID NO: 120868 - DNA, 30 bp, Homo sapiens; identical to SEQ ID NO: 89082
  chr22:18272947-18272977
  Hypo

SEQ ID NO: 120869 - DNA, 263 bp, Homo sapiens; identical to SEQ ID NO: 89083
  chr22:18328093-18328356
  Hypo

SEQ ID NO: 120870 - DNA, 130 bp, Homo sapiens; identical to SEQ ID NO: 89084
  chr22:18355580-18355710
  Hypo

SEQ ID NO: 120871 - DNA, 30 bp, Homo sapiens; identical to SEQ ID NO: 89085
  chr22:18422755-18422785
  Hypo

SEQ ID NO: 120872 - DNA, 30 bp, Homo sapiens; identical to SEQ ID NO: 89086
  chr22:18432493-18432523
  Hypo

SEQ ID NO: 120873 - DNA, 30 bp, Homo sapiens; identical to SEQ ID NO: 89087
  chr22:18470447-18470477
  Hypo

SEQ ID NO: 120874 - DNA, 30 bp, Homo sapiens; identical to SEQ ID NO: 89088
  chr22:18553593-18553623
  Hypo

SEQ ID NO: 120875 - DNA, 121 bp, Homo sapiens; identical to SEQ ID NO: 89089
  chr22:18553829-18553950
  Hypo

SEQ ID NO: 120876 - DNA, 53 bp, Homo sapiens; identical to SEQ ID NO: 46618
  chr22:18634479-18634532
  Hypo

SEQ ID NO: 120877 - DNA, 196 bp, Homo sapiens; identical to SEQ ID NO: 89091
  chr22:18923386-18923582
  Hyper

SEQ ID NO: 120878 - DNA, 116 bp, Homo sapiens; identical to SEQ ID NO: 89092
  chr22:18958033-18958149
  Hyper

SEQ ID NO: 120879 - DNA, 209 bp, Homo sapiens; identical to SEQ ID NO: 89093
  chr22:18986543-18986752
  Hyper

SEQ ID NO: 120880 - DNA, 30 bp, Homo sapiens; identical to SEQ ID NO: 89094
  chr22:19011932-19011962
  Hypo

SEQ ID NO: 120881 - DNA, 760 bp, Homo sapiens; identical to SEQ ID NO: 89095
  chr22:19016838-19017598
  Hyper

SEQ ID NO: 120882 - DNA, 166 bp, Homo sapiens; identical to SEQ ID NO: 89096
  chr22:19020499-19020665
  Hypo

SEQ ID NO: 120883 - DNA, 42 bp, Homo sapiens; identical to SEQ ID NO: 89097
  chr22:19030399-19030441
  Hypo

SEQ ID NO: 120884 - DNA, 45 bp, Homo sapiens; identical to SEQ ID NO: 89098
  chr22:19048344-19048389
  Hypo

SEQ ID NO: 120885 - DNA, 139 bp, Homo sapiens; identical to SEQ ID NO: 46619
  chr22:19117537-19117676
  Hypo

SEQ ID NO: 120886 - DNA, 30 bp, Homo sapiens; identical to SEQ ID NO: 89100
  chr22:19125886-19125916
  Hypo

SEQ ID NO: 120887 - DNA, 80 bp, Homo sapiens; identical to SEQ ID NO: 89101
  chr22:19132825-19132905
  Hypo

SEQ ID NO: 120888 - DNA, 56 bp, Homo sapiens; identical to SEQ ID NO: 89102
  chr22:19444363-19444419
  Hypo

SEQ ID NO: 120889 - DNA, 1678 bp, Homo sapiens
  chr22:19510749-19512427
  Hyper
ctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaa

SEQ ID NO: 120890 - DNA, 499 bp, Homo sapiens
  chr22:19706198-19706697
  Hyper
ctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggc

SEQ ID NO: 120891 - DNA, 202 bp, Homo sapiens
  chr22:19711085-19711287
  Hyper
tctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggct

SEQ ID NO: 120892 - DNA, 262 bp, Homo sapiens
  chr22:19711690-19711952
  Hyper
gagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgc

SEQ ID NO: 120893 - DNA, 49 bp, Homo sapiens; identical to SEQ ID NO: 89111
  chr22:19723403-19723452
  Hypo

SEQ ID NO: 120894 - DNA, 30 bp, Homo sapiens; identical to SEQ ID NO: 89112
  chr22:19726569-19726599
  Hypo

SEQ ID NO: 120895 - DNA, 379 bp, Homo sapiens
  chr22:19742613-19742992
  Hyper
ttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcccgctcccgctcctcccccgccacccccgcccgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggaggga

SEQ ID NO: 120896 - DNA, 37 bp, Homo sapiens; identical to SEQ ID NO: 89115
  chr22:19748231-19748268
  Hyper

SEQ ID NO: 120897 - DNA, 474 bp, Homo sapiens
  chr22:19748589-19749063
  Hyper
cgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgagga

SEQ ID NO: 120898 - DNA, 219 bp, Homo sapiens; identical to SEQ ID NO: 89118
  chr22:19771670-19771889
  Hypo

SEQ ID NO: 120899 - DNA, 30 bp, Homo sapiens; identical to SEQ ID NO: 89119
  chr22:19839985-19840015
  Hypo

SEQ ID NO: 120900 - DNA, 43 bp, Homo sapiens; identical to SEQ ID NO: 89120
  chr22:19856455-19856498
  Hypo

SEQ ID NO: 120901 - DNA, 47 bp, Homo sapiens; identical to SEQ ID NO: 89121
  chr22:19876172-19876219
  Hypo

SEQ ID NO: 120902 - DNA, 30 bp, Homo sapiens; identical to SEQ ID NO: 89122
  chr22:19951604-19951634
  Hypo

SEQ ID NO: 120903 - DNA, 38 bp, Homo sapiens; identical to SEQ ID NO: 89123
  chr22:19961683-19961721
  Hypo

SEQ ID NO: 120904 - DNA, 155 bp, Homo sapiens; identical to SEQ ID NO: 89124
  chr22:19964966-19965121
  Hypo

SEQ ID NO: 120905 - DNA, 71 bp, Homo sapiens; identical to SEQ ID NO: 89125
  chr22:19970544-19970615
  Hypo

SEQ ID NO: 120906 - DNA, 142 bp, Homo sapiens; identical to SEQ ID NO: 89126
  chr22:20027370-20027512
  Hypo

SEQ ID NO: 120907 - DNA, 121 bp, Homo sapiens; identical to SEQ ID NO: 89127
  chr22:20027900-20028021
  Hypo

SEQ ID NO: 120908 - DNA, 30 bp, Homo sapiens; identical to SEQ ID NO: 89128
  chr22:20108065-20108095
  Hypo

SEQ ID NO: 120909 - DNA, 42 bp, Homo sapiens; identical to SEQ ID NO: 89129
  chr22:20137019-20137061
  Hypo

SEQ ID NO: 120910 - DNA, 151 bp, Homo sapiens; identical to SEQ ID NO: 46623
  chr22:20166058-20166209
  Hypo

SEQ ID NO: 120911 - DNA, 44 bp, Homo sapiens; identical to SEQ ID NO: 89131
  chr22:20254350-20254394
  Hypo

SEQ ID NO: 120912 - DNA, 217 bp, Homo sapiens; identical to SEQ ID NO: 89132
  chr22:20271994-20272211
  Hypo

SEQ ID NO: 120913 - DNA, 30 bp, Homo sapiens; identical to SEQ ID NO: 89133
  chr22:20285993-20286023
  Hypo

SEQ ID NO: 120914 - DNA, 30 bp, Homo sapiens; identical to SEQ ID NO: 89134
  chr22:20287662-20287692
  Hyper

SEQ ID NO: 120915 - DNA, 79 bp, Homo sapiens; identical to SEQ ID NO: 89135
  chr22:20295969-20296048
  Hypo

SEQ ID NO: 120916 - DNA, 86 bp, Homo sapiens; identical to SEQ ID NO: 89136
  chr22:20308760-20308846
  Hypo

SEQ ID NO: 120917 - DNA, 42 bp, Homo sapiens; identical to SEQ ID NO: 89137
  chr22:20749361-20749403
  Hypo

SEQ ID NO: 120918 - DNA, 23 bp, Homo sapiens
  chr22:20765466-20765489
  Hypo
aacatgaacggctgggcacagcc

SEQ ID NO: 120919 - DNA, 2041 bp, Homo sapiens
  chr22:20790558-20792599
  Hyper
gctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcccgcgcctttccctccgctccctagacatctaccgaagcagccgcccctgcgcgcccactgcgtaggccaggcccgggacgggaaggcggatcggggacacggacgcgactccgcaagcccacccccgctcccagcgcctcggaaccggccaagggagtggggcccgcagacagcccaggtcgaggccgaaagccaactccacagcaccccaccgcgaagtccttgtagt

SEQ ID NO: 120920 - DNA, 40 bp, Homo sapiens; identical to SEQ ID NO: 89141
  chr22:20851270-20851310
  Hypo

SEQ ID NO: 120921 - DNA, 88 bp, Homo sapiens; identical to SEQ ID NO: 89142
  chr22:20864327-20864415
  Hypo

SEQ ID NO: 120922 - DNA, 147 bp, Homo sapiens; identical to SEQ ID NO: 89143
  chr22:20864655-20864802
  Hypo

SEQ ID NO: 120923 - DNA, 92 bp, Homo sapiens; identical to SEQ ID NO: 89144
  chr22:20933768-20933860
  Hypo

SEQ ID NO: 120924 - DNA, 30 bp, Homo sapiens; identical to SEQ ID NO: 89145
  chr22:21011807-21011837
  Hypo

SEQ ID NO: 120925 - DNA, 46 bp, Homo sapiens; identical to SEQ ID NO: 89146
  chr22:21024902-21024948
  Hypo

SEQ ID NO: 120926 - DNA, 84 bp, Homo sapiens; identical to SEQ ID NO: 89147
  chr22:21058566-21058650
  Hyper

SEQ ID NO: 120927 - DNA, 149 bp, Homo sapiens; identical to SEQ ID NO: 89148
  chr22:21105244-21105393
  Hypo

SEQ ID NO: 120928 - DNA, 30 bp, Homo sapiens; identical to SEQ ID NO: 46630
  chr22:21150528-21150558
  Hypo

SEQ ID NO: 120929 - DNA, 30 bp, Homo sapiens; identical to SEQ ID NO: 46631
  chr22:21153993-21154023
  Hypo

SEQ ID NO: 120930 - DNA, 91 bp, Homo sapiens; identical to SEQ ID NO: 46632
  chr22:21214252-21214343
  Hypo

SEQ ID NO: 120931 - DNA, 29 bp, Homo sapiens
  chr22:21304978-21305007
  Hypo
gccgtgagccgccgcgcctggcctagact

SEQ ID NO: 120932 - DNA, 592 bp, Homo sapiens; identical to SEQ ID NO: 89153
  chr22:21311370-21311962
  Hyper

SEQ ID NO: 120933 - DNA, 32 bp, Homo sapiens; identical to SEQ ID NO: 38476
  chr22:21319163-21319195
  Hyper

SEQ ID NO: 120934 - DNA, 306 bp, Homo sapiens; identical to SEQ ID NO: 89155
  chr22:21319585-21319891
  Hyper

SEQ ID NO: 120935 - DNA, 276 bp, Homo sapiens; identical to SEQ ID NO: 89156
  chr22:21333740-21334016
  Hyper

SEQ ID NO: 120936 - DNA, 260 bp, Homo sapiens; identical to SEQ ID NO: 89157
  chr22:21354214-21354474
  Hypo

SEQ ID NO: 120937 - DNA, 396 bp, Homo sapiens
  chr22:21368301-21368697
  Hyper
ctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgct

SEQ ID NO: 120938 - DNA, 63 bp, Homo sapiens; identical to SEQ ID NO: 89160
  chr22:21380295-21380358
  Hypo

SEQ ID NO: 120939 - DNA, 434 bp, Homo sapiens
  chr22:21386579-21387013
  Hyper
acagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaag

SEQ ID NO: 120940 - DNA, 240 bp, Homo sapiens; identical to SEQ ID NO: 89163
  chr22:21400043-21400283
  Hyper

SEQ ID NO: 120941 - DNA, 30 bp, Homo sapiens; identical to SEQ ID NO: 89164
  chr22:21805390-21805420
  Hypo

SEQ ID NO: 120942 - DNA, 30 bp, Homo sapiens
  chr22:21823907-21823937
  Hyper
ggtgcgtgctgggcgcgctgcaggtgctgc

SEQ ID NO: 120943 - DNA, 30 bp, Homo sapiens; identical to SEQ ID NO: 89165
  chr22:21945402-21945432
  Hypo

SEQ ID NO: 120944 - DNA, 45 bp, Homo sapiens; identical to SEQ ID NO: 89166
  chr22:21977345-21977390
  Hypo

SEQ ID NO: 120945 - DNA, 36 bp, Homo sapiens; identical to SEQ ID NO: 89167
  chr22:21978264-21978300
  Hypo

SEQ ID NO: 120946 - DNA, 249 bp, Homo sapiens; identical to SEQ ID NO: 89168
  chr22:21982792-21983041
  Hypo

SEQ ID NO: 120947 - DNA, 144 bp, Homo sapiens; identical to SEQ ID NO: 89169
  chr22:21986687-21986831
  Hypo

SEQ ID NO: 120948 - DNA, 20 bp, Homo sapiens
  chr22:21992966-21992986
  Hypo
attaacggcatgagcaactg

SEQ ID NO: 120949 - DNA, 50 bp, Homo sapiens; identical to SEQ ID NO: 89171
  chr22:22006098-22006148
  Hyper

SEQ ID NO: 120950 - DNA, 30 bp, Homo sapiens; identical to SEQ ID NO: 89172
  chr22:22036143-22036173
  Hypo

SEQ ID NO: 120951 - DNA, 333 bp, Homo sapiens; identical to SEQ ID NO: 89173
  chr22:22058076-22058409
  Hypo

SEQ ID NO: 120952 - DNA, 201 bp, Homo sapiens
  chr22:22090541-22090742
  Hyper
gctgaggcgagcttgcgcgcagcctcctcgtccagcgccgtgcacgtaccgcccgtccgcgcggtcggccgcgttgtaggggacggacgtggaggccgaggcgagcttgtgtgcgcctgaccagggcccgccttggccggacccctccgcggccgggtccccagaatgcggtcgtccgtgctgtcccgtccccaccaccct

SEQ ID NO: 120953 - DNA, 30 bp, Homo sapiens; identical to SEQ ID NO: 89174
  chr22:22272279-22272309
  Hypo

SEQ ID NO: 120954 - DNA, 30 bp, Homo sapiens; identical to SEQ ID NO: 46637
  chr22:22344036-22344066
  Hypo

SEQ ID NO: 120955 - DNA, 699 bp, Homo sapiens
  chr22:22862608-22863307
  Hyper
tttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtc

SEQ ID NO: 120956 - DNA, 379 bp, Homo sapiens; identical to SEQ ID NO: 89178
  chr22:22899599-22899978
  Hypo

SEQ ID NO: 120957 - DNA, 350 bp, Homo sapiens; identical to SEQ ID NO: 89179
  chr22:22901105-22901455
  Hypo

SEQ ID NO: 120958 - DNA, 30 bp, Homo sapiens; identical to SEQ ID NO: 89180
  chr22:23017536-23017566
  Hypo

SEQ ID NO: 120959 - DNA, 55 bp, Homo sapiens; identical to SEQ ID NO: 89181
  chr22:23437576-23437631
  Hypo

SEQ ID NO: 120960 - DNA, 170 bp, Homo sapiens; identical to SEQ ID NO: 89182
  chr22:23453131-23453301
  Hypo

SEQ ID NO: 120961 - DNA, 104 bp, Homo sapiens; identical to SEQ ID NO: 89183
  chr22:23791402-23791506
  Hypo

SEQ ID NO: 120962 - DNA, 30 bp, Homo sapiens; identical to SEQ ID NO: 89184
  chr22:23792721-23792751
  Hypo

SEQ ID NO: 120963 - DNA, 30 bp, Homo sapiens; identical to SEQ ID NO: 89185
  chr22:23800930-23800960
  Hypo

SEQ ID NO: 120964 - DNA, 30 bp, Homo sapiens; identical to SEQ ID NO: 89186
  chr22:23801462-23801492
  Hypo

SEQ ID NO: 120965 - DNA, 168 bp, Homo sapiens; identical to SEQ ID NO: 89187
  chr22:23860776-23860944
  Hypo

SEQ ID NO: 120966 - DNA, 215 bp, Homo sapiens; identical to SEQ ID NO: 89188
  chr22:23908072-23908287
  Hyper

SEQ ID NO: 120967 - DNA, 355 bp, Homo sapiens; identical to SEQ ID NO: 89189
  chr22:23908599-23908954
  Hyper

SEQ ID NO: 120968 - DNA, 126 bp, Homo sapiens; identical to SEQ ID NO: 89190
  chr22:23915557-23915683
  Hypo

SEQ ID NO: 120969 - DNA, 28 bp, Homo sapiens
  chr22:24091898-24091926
  Hypo
gcgtgagccccctcgcccagccctaaag

SEQ ID NO: 120970 - DNA, 1205 bp, Homo sapiens
  chr22:24180522-24181727
  Hyper
cctgcgggaaggatacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcccgggagccacgccgtaaccatggcgaccctcacccctcccgccagaggctgtaaccaaggcgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtggccaatgaggaactggtcatttcgcggctttctaggagaggaccagtagcgtggacccacgacaccacgggggcggggctaagatcgtatgggttacaggagcgaagacccgagcaggcgaggcaaaactggaaagggcggggcgcgtgggcggggcgcggagtgtggcggctcagaccgtgctggctcactaactgacgacctagccacaacgttgtcctcgctgccagcccaagacaggcccacctaacccacagcagggaggcattcgggaatgtgtccaa

SEQ ID NO: 120971 - DNA, 223 bp, Homo sapiens; identical to SEQ ID NO: 89194
  chr22:24209104-24209327
  Hypo

SEQ ID NO: 120972 - DNA, 30 bp, Homo sapiens; identical to SEQ ID NO: 89195
  chr22:24224775-24224805
  Hypo

SEQ ID NO: 120973 - DNA, 155 bp, Homo sapiens; identical to SEQ ID NO: 89196
  chr22:24238113-24238268
  Hypo

SEQ ID NO: 120974 - DNA, 1280 bp, Homo sapiens; identical to SEQ ID NO: 89197
  chr22:24551644-24552924
  Hyper

SEQ ID NO: 120975 - DNA, 34 bp, Homo sapiens; identical to SEQ ID NO: 46644
  chr22:24560385-24560419
  Hypo

SEQ ID NO: 120976 - DNA, 110 bp, Homo sapiens; identical to SEQ ID NO: 89199
  chr22:24580134-24580244
  Hypo

SEQ ID NO: 120977 - DNA, 84 bp, Homo sapiens; identical to SEQ ID NO: 89200
  chr22:24646515-24646599
  Hypo

SEQ ID NO: 120978 - DNA, 30 bp, Homo sapiens; identical to SEQ ID NO: 89201
  chr22:24721228-24721258
  Hyper

SEQ ID NO: 120979 - DNA, 412 bp, Homo sapiens; identical to SEQ ID NO: 89202
  chr22:24820074-24820486
  Hyper

SEQ ID NO: 120980 - DNA, 30 bp, Homo sapiens; identical to SEQ ID NO: 89203
  chr22:24985165-24985195
  Hypo

SEQ ID NO: 120981 - DNA, 30 bp, Homo sapiens; identical to SEQ ID NO: 46646
  chr22:25091239-25091269
  Hypo

SEQ ID NO: 120982 - DNA, 21 bp, Homo sapiens
  chr22:25171155-25171176
  Hypo
tcctcacgtggaagagtggaa

SEQ ID NO: 120983 - DNA, 30 bp, Homo sapiens; identical to SEQ ID NO: 89206
  chr22:25297771-25297801
  Hypo

SEQ ID NO: 120984 - DNA, 30 bp, Homo sapiens; identical to SEQ ID NO: 89207
  chr22:25339267-25339297
  Hypo

SEQ ID NO: 120985 - DNA, 43 bp, Homo sapiens; identical to SEQ ID NO: 89208
  chr22:25348442-25348485
  Hyper

SEQ ID NO: 120986 - DNA, 76 bp, Homo sapiens; identical to SEQ ID NO: 89209
  chr22:25349272-25349348
  Hyper

SEQ ID NO: 120987 - DNA, 36 bp, Homo sapiens; identical to SEQ ID NO: 89210
  chr22:25458444-25458480
  Hyper

SEQ ID NO: 120988 - DNA, 1219 bp, Homo sapiens
  chr22:25678246-25679465
  Hyper
cttcatcattacctgcggggacaggtgggacacatgcatttccggggtcatcccagacctcctggaggatgctgattgatgctgtcccgtttgagaactactgtgtccaggtagcagaggcctccccgatgccccttgagtagtgggcacggggcccagggcttctctggatgagctgggcgggcatgagaacgcatggagctgggggcaggaggtcggagcagcgaacgaggaggagaaggagtaggcggaggccgaaggagaggtgggggaggaagaagaggaggaggaggagtcccttgtggccaccccgaagggagggagggctaccgtagagacttggtcgagaggcgcgggacaagcctggccgctgggactgtgcgctgaggtgcaccgaccgtcgggccgcgagctccccgcagaccctcgcggaatgagctggggggcggcgcgcgaggcggcggagcggaaggcgcactgcgaccccggcgggctacagcctgcggcgcttgcagggcgctggtggggcgcgccgagcaggggctgccctggggctgccccagtcccaccaggtcggggctcagctggcggcggcggcggcggtggcggcagcgcgtcccatccgggtccgagtaaccgccgccgccgccaaaactcgccaacgtggcggacccggaggctgtgctggcagatgccagttacctgatggccatggagaagagcaaggcgactccggccgcccgcgccagcaagaggaccgtcctgcccgatcccaggtaccagctgccccggcccgcgctggtccccacgccgccgtccccaagcggccgtcagcgacctcctgcgtccgggagggtcgggcattgagtcgtcgctgtcctgggtgcgggtgacaccgcggaactggcgatgcggggccggcctccccgttccagtctctgaaatggggcatcggatggccggtgggggggactccgggagagagcgctccaaagtgcccagcgcggcgccctgcgcgcagcgagcgccccagggaggggctggttatgacttggctggaccagctccatccctgtcgccccctccccccggccctgtcctgtcctgtcccatccccgtggttcttcctgttgcattggtgtggtccctgtgggctcgttgcctgtcactcctttgcgctccttcttggtcgctgcttcttccccggctctgtggtccc

SEQ ID NO: 120989 - DNA, 867 bp, Homo sapiens; identical to SEQ ID NO: 89215
  chr22:25816871-25817738
  Hyper

SEQ ID NO: 120990 - DNA, 210 bp, Homo sapiens; identical to SEQ ID NO: 89216
  chr22:26124910-26125120
  Hypo

SEQ ID NO: 120991 - DNA, 158 bp, Homo sapiens; identical to SEQ ID NO: 89217
  chr22:26161975-26162133
  Hypo

SEQ ID NO: 120992 - DNA, 30 bp, Homo sapiens; identical to SEQ ID NO: 89218
  chr22:26238111-26238141
  Hypo

SEQ ID NO: 120993 - DNA, 30 bp, Homo sapiens; identical to SEQ ID NO: 89219
  chr22:26268171-26268201
  Hypo

SEQ ID NO: 120994 - DNA, 141 bp, Homo sapiens; identical to SEQ ID NO: 89220
  chr22:26564752-26564893
  Hyper

SEQ ID NO: 120995 - DNA, 834 bp, Homo sapiens
  chr22:26565165-26565999
  Hyper
cagagctgctgggagcgtcagcagggagagaaaacgctcggctcccaggacgcaaggggaattggcgttaaactttgcagggccgacgggccggcggccagaggaggcggctggcacccccggcgccgccgcggcccctccagctcactgcccgctcgcccgccccctccctccctgcactcgctcggcacagactcggccccagccccctccctcctcccgctcgctccacgctcgttcgctcgctcgccggctcctcctcactcgcccgcccgcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgaggtaagcgccccgaggggcggggcgggcagggggcaaagttgccgggagagcggggcagccaggggtcggggctgaccagggcgactcaggcaccacccgccgggatgggaagcggtggtggctgtccaaaatcggggctaggaaccgcacgtccccttggcccgggctgatgggagtgtggaggcggggatgtgttgaaggactcgggcgcttccctgcttcggctgcgggctccctttcggtcttccccggctgcggggctgattctcc

SEQ ID NO: 120996 - DNA, 32 bp, Homo sapiens; identical to SEQ ID NO: 89224
  chr22:26738332-26738364
  Hypo

SEQ ID NO: 120997 - DNA, 30 bp, Homo sapiens; identical to SEQ ID NO: 46648
  chr22:26763231-26763261
  Hypo

SEQ ID NO: 120998 - DNA, 46 bp, Homo sapiens; identical to SEQ ID NO: 89226
  chr22:26848744-26848790
  Hypo

SEQ ID NO: 120999 - DNA, 192 bp, Homo sapiens; identical to SEQ ID NO: 89227
  chr22:26930338-26930530
  Hypo

SEQ ID NO: 121000 - DNA, 38 bp, Homo sapiens; identical to SEQ ID NO: 46649
  chr22:26932483-26932521
  Hypo

SEQ ID NO: 121001 - DNA, 28 bp, Homo sapiens
  chr22:26965177-26965205
  Hypo
tggatcgggaccccgttccagtaacagt

SEQ ID NO: 121002 - DNA, 21 bp, Homo sapiens
  chr22:26991250-26991271
  Hypo
gcctgtgaggccaggcgcagt

SEQ ID NO: 121003 - DNA, 30 bp, Homo sapiens; identical to SEQ ID NO: 89231
  chr22:26997870-26997900
  Hypo

SEQ ID NO: 121004 - DNA, 78 bp, Homo sapiens; identical to SEQ ID NO: 89232
  chr22:26998743-26998821
  Hypo

SEQ ID NO: 121005 - DNA, 50 bp, Homo sapiens; identical to SEQ ID NO: 89233
  chr22:27007819-27007869
  Hypo

SEQ ID NO: 121006 - DNA, 20 bp, Homo sapiens
  chr22:27010657-27010677
  Hypo
taaaaacaagtaaatcggcc

SEQ ID NO: 121007 - DNA, 80 bp, Homo sapiens; identical to SEQ ID NO: 89235
  chr22:27019215-27019295
  Hypo

SEQ ID NO: 121008 - DNA, 154 bp, Homo sapiens; identical to SEQ ID NO: 89236
  chr22:27045844-27045998
  Hypo

SEQ ID NO: 121009 - DNA, 511 bp, Homo sapiens; identical to SEQ ID NO: 89237
  chr22:27053517-27054028
  Hyper

SEQ ID NO: 121010 - DNA, 317 bp, Homo sapiens; identical to SEQ ID NO: 89238
  chr22:27068921-27069238
  Hyper

SEQ ID NO: 121011 - DNA, 30 bp, Homo sapiens; identical to SEQ ID NO: 89239
  chr22:27299019-27299049
  Hyper

SEQ ID NO: 121012 - DNA, 33 bp, Homo sapiens; identical to SEQ ID NO: 89240
  chr22:27299656-27299689
  Hyper

SEQ ID NO: 121013 - DNA, 287 bp, Homo sapiens; identical to SEQ ID NO: 89241
  chr22:27695150-27695437
  Hyper

SEQ ID NO: 121014 - DNA, 30 bp, Homo sapiens; identical to SEQ ID NO: 89242
  chr22:27728029-27728059
  Hyper

SEQ ID NO: 121015 - DNA, 112 bp, Homo sapiens; identical to SEQ ID NO: 89243
  chr22:28007163-28007275
  Hypo

SEQ ID NO: 121016 - DNA, 30 bp, Homo sapiens; identical to SEQ ID NO: 89244
  chr22:28017941-28017971
  Hypo

SEQ ID NO: 121017 - DNA, 30 bp, Homo sapiens; identical to SEQ ID NO: 89245
  chr22:28035016-28035046
  Hypo

SEQ ID NO: 121018 - DNA, 30 bp, Homo sapiens; identical to SEQ ID NO: 38505
  chr22:28196522-28196552
  Hyper

SEQ ID NO: 121019 - DNA, 83 bp, Homo sapiens; identical to SEQ ID NO: 89247
  chr22:28196966-28197049
  Hyper

SEQ ID NO: 121020 - DNA, 1244 bp, Homo sapiens; identical to SEQ ID NO: 89248
  chr22:28197259-28198503
  Hyper

SEQ ID NO: 121021 - DNA, 220 bp, Homo sapiens; identical to SEQ ID NO: 89249
  chr22:28371504-28371724
  Hypo

SEQ ID NO: 121022 - DNA, 270 bp, Homo sapiens; identical to SEQ ID NO: 89250
  chr22:28838179-28838449
  Hyper

SEQ ID NO: 121023 - DNA, 50 bp, Homo sapiens; identical to SEQ ID NO: 38510
  chr22:28838794-28838844
  Hyper

SEQ ID NO: 121024 - DNA, 813 bp, Homo sapiens; identical to SEQ ID NO: 38511
  chr22:29075406-29076219
  Hyper

SEQ ID NO: 121025 - DNA, 18 bp, Homo sapiens
  chr22:29167152-29167170
  Hypo
ccacggagcccagccaaa

SEQ ID NO: 121026 - DNA, 120 bp, Homo sapiens; identical to SEQ ID NO: 89254
  chr22:29167697-29167817
  Hypo

SEQ ID NO: 121027 - DNA, 30 bp, Homo sapiens; identical to SEQ ID NO: 46657
  chr22:29168256-29168286
  Hypo

SEQ ID NO: 121028 - DNA, 94 bp, Homo sapiens; identical to SEQ ID NO: 89256
  chr22:29426559-29426653
  Hyper

SEQ ID NO: 121029 - DNA, 1051 bp, Homo sapiens; identical to SEQ ID NO: 89257
  chr22:29445592-29446643
  Hypo

SEQ ID NO: 121030 - DNA, 30 bp, Homo sapiens; identical to SEQ ID NO: 89258
  chr22:29467712-29467742
  Hyper

SEQ ID NO: 121031 - DNA, 106 bp, Homo sapiens; identical to SEQ ID NO: 89259
  chr22:29469954-29470060
  Hyper

SEQ ID NO: 121032 - DNA, 34 bp, Homo sapiens; identical to SEQ ID NO: 89260
  chr22:29540984-29541018
  Hypo

SEQ ID NO: 121033 - DNA, 28 bp, Homo sapiens
  chr22:29550679-29550707
  Hyper
tccattacagttacacggattttttgcc

SEQ ID NO: 121034 - DNA, 45 bp, Homo sapiens; identical to SEQ ID NO: 89262
  chr22:29610336-29610381
  Hypo

SEQ ID NO: 121035 - DNA, 156 bp, Homo sapiens; identical to SEQ ID NO: 89263
  chr22:29611127-29611283
  Hypo

SEQ ID NO: 121036 - DNA, 167 bp, Homo sapiens; identical to SEQ ID NO: 89264
  chr22:29616031-29616198
  Hypo

SEQ ID NO: 121037 - DNA, 22 bp, Homo sapiens
  chr22:29617650-29617672
  Hypo
ccacgcccggccaggatatgac

SEQ ID NO: 121038 - DNA, 24 bp, Homo sapiens
  chr22:29701029-29701053
  Hypo
gcgcccggccgggaatgttaagac

SEQ ID NO: 121039 - DNA, 100 bp, Homo sapiens; identical to SEQ ID NO: 89267
  chr22:29709200-29709300
  Hyper

SEQ ID NO: 121040 - DNA, 37 bp, Homo sapiens; identical to SEQ ID NO: 89268
  chr22:29710305-29710342
  Hyper

SEQ ID NO: 121041 - DNA, 467 bp, Homo sapiens; identical to SEQ ID NO: 89269
  chr22:29711155-29711622
  Hyper

SEQ ID NO: 121042 - DNA, 34 bp, Homo sapiens; identical to SEQ ID NO: 89270
  chr22:29736031-29736065
  Hypo

SEQ ID NO: 121043 - DNA, 149 bp, Homo sapiens; identical to SEQ ID NO: 89271
  chr22:29773804-29773953
  Hypo

SEQ ID NO: 121044 - DNA, 209 bp, Homo sapiens
  chr22:29875904-29876113
  Hyper
tcccctttcttattccgaacacactcgcaggctcttccgacgcgcacccgggggtcctcactggcccactccgggagtcctctgcccgcttccccgacctcgagggtctcctctgacgcagcgtcgattccccttccctcctcggtcccctgccccgcccctctcactgcggcggagccggtcggccggggggccgcaggggaggaggc

SEQ ID NO: 121045 - DNA, 669 bp, Homo sapiens; identical to SEQ ID NO: 38516
  chr22:29876916-29877585
  Hyper

SEQ ID NO: 121046 - DNA, 120 bp, Homo sapiens; identical to SEQ ID NO: 89275
  chr22:29977635-29977755
  Hypo

SEQ ID NO: 121047 - DNA, 81 bp, Homo sapiens; identical to SEQ ID NO: 89276
  chr22:29977935-29978016
  Hypo

SEQ ID NO: 121048 - DNA, 24 bp, Homo sapiens
  chr22:29997189-29997213
  Hypo
cctttttttttgagacggagtctc

SEQ ID NO: 121049 - DNA, 36 bp, Homo sapiens; identical to SEQ ID NO: 46664
  chr22:29998650-29998686
  Hypo

SEQ ID NO: 121050 - DNA, 30 bp, Homo sapiens; identical to SEQ ID NO: 89279
  chr22:30023357-30023387
  Hypo

SEQ ID NO: 121051 - DNA, 128 bp, Homo sapiens; identical to SEQ ID NO: 89280
  chr22:30087744-30087872
  Hypo

SEQ ID NO: 121052 - DNA, 191 bp, Homo sapiens; identical to SEQ ID NO: 89281
  chr22:30091110-30091301
  Hypo

SEQ ID NO: 121053 - DNA, 1178 bp, Homo sapiens; identical to SEQ ID NO: 89282
  chr22:30115961-30117139
  Hyper

SEQ ID NO: 121054 - DNA, 35 bp, Homo sapiens; identical to SEQ ID NO: 89283
  chr22:30158330-30158365
  Hypo

SEQ ID NO: 121055 - DNA, 30 bp, Homo sapiens; identical to SEQ ID NO: 89284
  chr22:30198046-30198076
  Hypo

SEQ ID NO: 121056 - DNA, 44 bp, Homo sapiens; identical to SEQ ID NO: 89285
  chr22:30233100-30233144
  Hypo

SEQ ID NO: 121057 - DNA, 24 bp, Homo sapiens
  chr22:30375203-30375227
  Hypo
aggcgcggtggctcacgcctgtaa

SEQ ID NO: 121058 - DNA, 30 bp, Homo sapiens; identical to SEQ ID NO: 89287
  chr22:30606857-30606887
  Hypo

SEQ ID NO: 121059 - DNA, 30 bp, Homo sapiens; identical to SEQ ID NO: 89288
  chr22:30634326-30634356
  Hypo

SEQ ID NO: 121060 - DNA, 99 bp, Homo sapiens; identical to SEQ ID NO: 89289
  chr22:30642585-30642684
  Hyper

SEQ ID NO: 121061 - DNA, 54 bp, Homo sapiens; identical to SEQ ID NO: 89290
  chr22:30767980-30768034
  Hypo

SEQ ID NO: 121062 - DNA, 30 bp, Homo sapiens; identical to SEQ ID NO: 89291
  chr22:30769627-30769657
  Hypo

SEQ ID NO: 121063 - DNA, 102 bp, Homo sapiens; identical to SEQ ID NO: 46669
  chr22:30783894-30783996
  Hypo

SEQ ID NO: 121064 - DNA, 30 bp, Homo sapiens; identical to SEQ ID NO: 89293
  chr22:30836081-30836111
  Hypo

SEQ ID NO: 121065 - DNA, 443 bp, Homo sapiens; identical to SEQ ID NO: 89294
  chr22:30857284-30857727
  Hypo

SEQ ID NO: 121066 - DNA, 30 bp, Homo sapiens; identical to SEQ ID NO: 89295
  chr22:30899622-30899652
  Hypo

SEQ ID NO: 121067 - DNA, 30 bp, Homo sapiens; identical to SEQ ID NO: 46671
  chr22:30924831-30924861
  Hypo

SEQ ID NO: 121068 - DNA, 142 bp, Homo sapiens; identical to SEQ ID NO: 89297
  chr22:30926975-30927117
  Hypo

SEQ ID NO: 121069 - DNA, 630 bp, Homo sapiens
  chr22:30938028-30938658
  Hyper
cgcgaaagggcaggccggtgggcggggacgcccggctcagaccccgtccccagcctggacctgggccccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggagggttaaaaggcagacacccccccacccccgcgcctccactccccgactccttcgccgcctccagcctctcgccagtgggaagcgggagtagccgcgcggccggagtccggaggcgaggggaggtcggccgcaacttccccaggccaccttaagaggacgatgtagccagctcgcagcgctgacctcagaaaaacaagtttgcgcaaagtggagcggggacccggcctctgggcagccccggcggcgcttctagtgccttccagccctcgcgggcggcgtagccgcggcccatggagcccgcgggccggtccccggccgcctcgggccgctgctctgcctgctgctccccgcgtcctgcgcctggtcaggagtggcgggtgaggaggagc

SEQ ID NO: 121070 - DNA, 30 bp, Homo sapiens; identical to SEQ ID NO: 46672
  chr22:30940902-30940932
  Hypo

SEQ ID NO: 121071 - DNA, 19 bp, Homo sapiens
  chr22:30962611-30962630
  Hypo
cttgagacagagtctcgct

SEQ ID NO: 121072 - DNA, 55 bp, Homo sapiens; identical to SEQ ID NO: 89302
  chr22:31003131-31003186
  Hyper

SEQ ID NO: 121073 - DNA, 260 bp, Homo sapiens; identical to SEQ ID NO: 89303
  chr22:31198492-31198752
  Hyper

SEQ ID NO: 121074 - DNA, 702 bp, Homo sapiens; identical to SEQ ID NO: 89304
  chr22:31218244-31218946
  Hyper

SEQ ID NO: 121075 - DNA, 30 bp, Homo sapiens; identical to SEQ ID NO: 89305
  chr22:31280871-31280901
  Hypo

SEQ ID NO: 121076 - DNA, 40 bp, Homo sapiens; identical to SEQ ID NO: 89306
  chr22:31317641-31317681
  Hyper

SEQ ID NO: 121077 - DNA, 30 bp, Homo sapiens; identical to SEQ ID NO: 46673
  chr22:31460423-31460453
  Hypo

SEQ ID NO: 121078 - DNA, 880 bp, Homo sapiens; identical to SEQ ID NO: 89308
  chr22:31480651-31481531
  Hyper

SEQ ID NO: 121079 - DNA, 65 bp, Homo sapiens; identical to SEQ ID NO: 89309
  chr22:31494732-31494797
  Hypo

SEQ ID NO: 121080 - DNA, 140 bp, Homo sapiens; identical to SEQ ID NO: 89310
  chr22:31639212-31639352
  Hypo

SEQ ID NO: 121081 - DNA, 30 bp, Homo sapiens; identical to SEQ ID NO: 89311
  chr22:32009388-32009418
  Hypo

SEQ ID NO: 121082 - DNA, 140 bp, Homo sapiens; identical to SEQ ID NO: 89312
  chr22:32014233-32014373
  Hypo

SEQ ID NO: 121083 - DNA, 68 bp, Homo sapiens; identical to SEQ ID NO: 89313
  chr22:32019687-32019755
  Hypo

SEQ ID NO: 121084 - DNA, 91 bp, Homo sapiens; identical to SEQ ID NO: 89314
  chr22:32058932-32059023
  Hypo

SEQ ID NO: 121085 - DNA, 30 bp, Homo sapiens; identical to SEQ ID NO: 89315
  chr22:32059263-32059293
  Hypo

SEQ ID NO: 121086 - DNA, 39 bp, Homo sapiens; identical to SEQ ID NO: 89316
  chr22:32062176-32062215
  Hypo

SEQ ID NO: 121087 - DNA, 27 bp, Homo sapiens
  chr22:32356779-32356806
  Hypo
aaactccgtccccgccccccccccccc

SEQ ID NO: 121088 - DNA, 30 bp, Homo sapiens; identical to SEQ ID NO: 89318
  chr22:32530895-32530925
  Hypo

SEQ ID NO: 121089 - DNA, 549 bp, Homo sapiens; identical to SEQ ID NO: 89319
  chr22:32571939-32572488
  Hyper

SEQ ID NO: 121090 - DNA, 30 bp, Homo sapiens; identical to SEQ ID NO: 89320
  chr22:32601764-32601794
  Hypo

SEQ ID NO: 121091 - DNA, 69 bp, Homo sapiens; identical to SEQ ID NO: 89321
  chr22:32650981-32651050
  Hypo

SEQ ID NO: 121092 - DNA, 127 bp, Homo sapiens; identical to SEQ ID NO: 89322
  chr22:32667536-32667663
  Hypo

SEQ ID NO: 121093 - DNA, 119 bp, Homo sapiens; identical to SEQ ID NO: 89323
  chr22:32701637-32701756
  Hypo

SEQ ID NO: 121094 - DNA, 86 bp, Homo sapiens; identical to SEQ ID NO: 89324
  chr22:32748880-32748966
  Hypo

SEQ ID NO: 121095 - DNA, 164 bp, Homo sapiens; identical to SEQ ID NO: 89325
  chr22:32958084-32958248
  Hypo

SEQ ID NO: 121096 - DNA, 24 bp, Homo sapiens
  chr22:33170623-33170647
  Hypo
gctggagtgcaatggcgcacgatc

SEQ ID NO: 121097 - DNA, 988 bp, Homo sapiens; identical to SEQ ID NO: 89327
  chr22:33197384-33198372
  Hyper

SEQ ID NO: 121098 - DNA, 185 bp, Homo sapiens; identical to SEQ ID NO: 89328
  chr22:33255195-33255380
  Hypo

SEQ ID NO: 121099 - DNA, 78 bp, Homo sapiens; identical to SEQ ID NO: 89329
  chr22:33286634-33286712
  Hypo

SEQ ID NO: 121100 - DNA, 30 bp, Homo sapiens; identical to SEQ ID NO: 89330
  chr22:33355598-33355628
  Hypo

SEQ ID NO: 121101 - DNA, 628 bp, Homo sapiens
  chr22:33453877-33454505
  Hyper
gcaggtcctaggagccggcgcagagcagaggtccggccgctgcggttcctggtttcccgcaagctcttccccgggccgggcgctgggtggaggcagtcttaggatccacagtcttgcgcgcccccggctcccgggcccggcagacggcccccgcacgccgatctgtctgtcccagggaccggcccagggccccggcagcggcagcctggggagacaccgtggtgcgcggctccttgcctccctccctgcccctccgtgcgcccgcatcccgcggacacagagccggagctccaggggacgcagcccgacgcgagaacgcaccagcagcccccgctcgaggtggggtctcccggctgtcagaaaccccacaaagtctactttgcggcgccgcgccgcttaccgtgcgagccgccaggaactcggcgcccggtggtgcctcggcgcggcgcccgccagtcgatccgctccgggtcccgggagctcagcctctgcccctcaacgcgcgcgagcgcccccgcccggcggcccggcctccccgcgccgcggcgccccattggctcgggcaacgaggcccccggacggccccgcccacccgcgcccactccctcgcccacgcctctccccaacg

SEQ ID NO: 121102 - DNA, 44 bp, Homo sapiens; identical to SEQ ID NO: 89335
  chr22:33492816-33492860
  Hypo

SEQ ID NO: 121103 - DNA, 42 bp, Homo sapiens; identical to SEQ ID NO: 89336
  chr22:33716477-33716519
  Hypo

SEQ ID NO: 121104 - DNA, 30 bp, Homo sapiens; identical to SEQ ID NO: 89337
  chr22:35292274-35292304
  Hypo

SEQ ID NO: 121105 - DNA, 30 bp, Homo sapiens; identical to SEQ ID NO: 89338
  chr22:35321014-35321044
  Hypo

SEQ ID NO: 121106 - DNA, 109 bp, Homo sapiens; identical to SEQ ID NO: 89339
  chr22:35420206-35420315
  Hyper

SEQ ID NO: 121107 - DNA, 98 bp, Homo sapiens; identical to SEQ ID NO: 89340
  chr22:35652867-35652965
  Hypo

SEQ ID NO: 121108 - DNA, 42 bp, Homo sapiens; identical to SEQ ID NO: 89341
  chr22:35768487-35768529
  Hypo

SEQ ID NO: 121109 - DNA, 96 bp, Homo sapiens; identical to SEQ ID NO: 46682
  chr22:35822686-35822782
  Hypo

SEQ ID NO: 121110 - DNA, 30 bp, Homo sapiens; identical to SEQ ID NO: 89343
  chr22:35827951-35827981
  Hypo

SEQ ID NO: 121111 - DNA, 64 bp, Homo sapiens; identical to SEQ ID NO: 46683
  chr22:35848324-35848388
  Hypo

SEQ ID NO: 121112 - DNA, 27 bp, Homo sapiens
  chr22:35853047-35853074
  Hypo
tttccagctgcccgtgctccttgagtt

SEQ ID NO: 121113 - DNA, 30 bp, Homo sapiens; identical to SEQ ID NO: 46684
  chr22:35964914-35964944
  Hypo

SEQ ID NO: 121114 - DNA, 39 bp, Homo sapiens; identical to SEQ ID NO: 89347
  chr22:36246196-36246235
  Hypo

SEQ ID NO: 121115 - DNA, 99 bp, Homo sapiens; identical to SEQ ID NO: 89348
  chr22:36246295-36246394
  Hypo

SEQ ID NO: 121116 - DNA, 175 bp, Homo sapiens; identical to SEQ ID NO: 89349
  chr22:36553193-36553368
  Hyper

SEQ ID NO: 121117 - DNA, 42 bp, Homo sapiens; identical to SEQ ID NO: 89350
  chr22:36566759-36566801
  Hypo

SEQ ID NO: 121118 - DNA, 42 bp, Homo sapiens; identical to SEQ ID NO: 89351
  chr22:36569398-36569440
  Hypo

SEQ ID NO: 121119 - DNA, 101 bp, Homo sapiens; identical to SEQ ID NO: 89352
  chr22:36585930-36586031
  Hypo

SEQ ID NO: 121120 - DNA, 30 bp, Homo sapiens; identical to SEQ ID NO: 89353
  chr22:36632925-36632955
  Hypo

SEQ ID NO: 121121 - DNA, 247 bp, Homo sapiens; identical to SEQ ID NO: 89354
  chr22:36684196-36684443
  Hypo

SEQ ID NO: 121122 - DNA, 30 bp, Homo sapiens; identical to SEQ ID NO: 89355
  chr22:36707722-36707752
  Hypo

SEQ ID NO: 121123 - DNA, 30 bp, Homo sapiens; identical to SEQ ID NO: 89356
  chr22:36721819-36721849
  Hypo

SEQ ID NO: 121124 - DNA, 30 bp, Homo sapiens; identical to SEQ ID NO: 38534
  chr22:36726916-36726946
  Hyper

SEQ ID NO: 121125 - DNA, 30 bp, Homo sapiens; identical to SEQ ID NO: 89358
  chr22:36795040-36795070
  Hypo

SEQ ID NO: 121126 - DNA, 39 bp, Homo sapiens; identical to SEQ ID NO: 89359
  chr22:36848073-36848112
  Hyper

SEQ ID NO: 121127 - DNA, 221 bp, Homo sapiens; identical to SEQ ID NO: 89360
  chr22:36851867-36852088
  Hypo

SEQ ID NO: 121128 - DNA, 30 bp, Homo sapiens; identical to SEQ ID NO: 89361
  chr22:36860909-36860939
  Hypo

SEQ ID NO: 121129 - DNA, 30 bp, Homo sapiens; identical to SEQ ID NO: 16776
  chr22:36878964-36878994
  Hypo

SEQ ID NO: 121130 - DNA, 764 bp, Homo sapiens; identical to SEQ ID NO: 89363
  chr22:36901801-36902565
  Hypo

SEQ ID NO: 121131 - DNA, 41 bp, Homo sapiens; identical to SEQ ID NO: 46691
  chr22:36906156-36906197
  Hypo

SEQ ID NO: 121132 - DNA, 637 bp, Homo sapiens; identical to SEQ ID NO: 89365
  chr22:37099142-37099779
  Hyper

SEQ ID NO: 121133 - DNA, 30 bp, Homo sapiens; identical to SEQ ID NO: 89366
  chr22:37121549-37121579
  Hypo

SEQ ID NO: 121134 - DNA, 492 bp, Homo sapiens
  chr22:37212414-37212906
  Hyper
gcactgaggatgccccgtgcgggcttaggcagagctgtgcgccggctccagaaggtcacctcgcccgcaggtccgttgctgaatctcagtaaaggaactaggacagtcagggggccaacaaaggctaccgcctggcgggaaaagtcctgtccagaatgagggtccaggaaaggggtctcttggagaggaggatgccccctgcagtcccctctaagtgccttaaagaggacgtccagagagctcgtacaaggaccctggaggtctctcctccgaccctggtcttcgcccttggtcccggaccctgagtcctcccagccaccgggccttcagcaccctcaagtttctgtaacttaggcggggcgccctcttccccgcccgctccccgcgccaagcctcgcccggacagagtttgggaactgccaaggacgcccccgccccgacctcgccggcgcccagcgggaagtgtgggcagaagcgcgctggggaggatcc

SEQ ID NO: 121135 - DNA, 179 bp, Homo sapiens; identical to SEQ ID NO: 89369
  chr22:37213140-37213319
  Hyper

SEQ ID NO: 121136 - DNA, 26 bp, Homo sapiens
  chr22:37285265-37285291
  Hypo
aagtactattcatgccgggcgcggtg

SEQ ID NO: 121137 - DNA, 30 bp, Homo sapiens; identical to SEQ ID NO: 89371
  chr22:37285909-37285939
  Hypo

SEQ ID NO: 121138 - DNA, 153 bp, Homo sapiens; identical to SEQ ID NO: 89372
  chr22:37321872-37322025
  Hypo

SEQ ID NO: 121139 - DNA, 173 bp, Homo sapiens; identical to SEQ ID NO: 89373
  chr22:37328730-37328903
  Hypo

SEQ ID NO: 121140 - DNA, 46 bp, Homo sapiens; identical to SEQ ID NO: 89374
  chr22:37329983-37330029
  Hypo

SEQ ID NO: 121141 - DNA, 239 bp, Homo sapiens; identical to SEQ ID NO: 89375
  chr22:37334157-37334396
  Hypo

SEQ ID NO: 121142 - DNA, 50 bp, Homo sapiens; identical to SEQ ID NO: 46695
  chr22:37335158-37335208
  Hypo

SEQ ID NO: 121143 - DNA, 115 bp, Homo sapiens; identical to SEQ ID NO: 89377
  chr22:37348877-37348992
  Hypo

SEQ ID NO: 121144 - DNA, 83 bp, Homo sapiens; identical to SEQ ID NO: 89378
  chr22:37367478-37367561
  Hypo

SEQ ID NO: 121145 - DNA, 30 bp, Homo sapiens; identical to SEQ ID NO: 46698
  chr22:37367799-37367829
  Hypo

SEQ ID NO: 121146 - DNA, 30 bp, Homo sapiens; identical to SEQ ID NO: 89380
  chr22:37377170-37377200
  Hypo

SEQ ID NO: 121147 - DNA, 20 bp, Homo sapiens
  chr22:37389811-37389831
  Hypo
gaaaacgaaaaataagatca

SEQ ID NO: 121148 - DNA, 30 bp, Homo sapiens; identical to SEQ ID NO: 89382
  chr22:37395703-37395733
  Hypo

SEQ ID NO: 121149 - DNA, 30 bp, Homo sapiens; identical to SEQ ID NO: 46699
  chr22:37395982-37396012
  Hypo

SEQ ID NO: 121150 - DNA, 30 bp, Homo sapiens; identical to SEQ ID NO: 89384
  chr22:37411386-37411416
  Hypo

SEQ ID NO: 121151 - DNA, 164 bp, Homo sapiens; identical to SEQ ID NO: 89385
  chr22:37483725-37483889
  Hypo

SEQ ID NO: 121152 - DNA, 30 bp, Homo sapiens; identical to SEQ ID NO: 89386
  chr22:37507640-37507670
  Hypo

SEQ ID NO: 121153 - DNA, 30 bp, Homo sapiens; identical to SEQ ID NO: 89387
  chr22:37578241-37578271
  Hypo

SEQ ID NO: 121154 - DNA, 30 bp, Homo sapiens; identical to SEQ ID NO: 89388
  chr22:37610830-37610860
  Hypo

SEQ ID NO: 121155 - DNA, 30 bp, Homo sapiens; identical to SEQ ID NO: 89389
  chr22:37646399-37646429
  Hypo

SEQ ID NO: 121156 - DNA, 821 bp, Homo sapiens
  chr22:37730457-37731278
  Hyper
tacaggtgagcaaagcgcggctcgggaaggtagctcctgccggaatggagcagaaacgtctcggctgggaatcgaacccagggtcagtcagtagcggccgcgttttaggacccggcggtgcaccgaagacccggcggaacggcgcgcaccccgggcccagagctcattagccgggcgccgcgggggccttcattaaagctcagcgacgcggaggctgcccgcggcggccccgcctgggcgctccgggctggcccggacctgcggcgtcggcccaggagcatctggaaagggggcgcgggcggggatcggtaggaccgcctatgctcagggactgtcacccaccccctcccccaagccaaggagtagcggggaaggggggcgagtgcacccaggtattggggggagcatcaaatcggagtggagggggccggtgtcaccgagctatccccaaacctcgaacggccaaggccgagtcacccccgccccacccccacacactatgcacccatttcacagatggcaggtcctagctcagagggttagggcaggcccagaaccgcatcgccatcgcccgttcgcaggcctgattgagaggctggaaacgaggatgggcagggagtgaggacctgtaggctctgccggagaacttgggcgtgggcggagcggggcatccaggaagaagcccccaccccagccttggatagggtagtatacgatagggggcgtaaagaagggtcatgggctccggtggtcgcaggtcccaccggcaaccgccagggcgggggcagcaggagcaggaacctgctcgcctccgcatctcg

SEQ ID NO: 121157 - DNA, 30 bp, Homo sapiens; identical to SEQ ID NO: 89392
  chr22:37734363-37734393
  Hypo

SEQ ID NO: 121158 - DNA, 30 bp, Homo sapiens; identical to SEQ ID NO: 89393
  chr22:37742873-37742903
  Hypo

SEQ ID NO: 121159 - DNA, 30 bp, Homo sapiens; identical to SEQ ID NO: 89394
  chr22:37769281-37769311
  Hypo

SEQ ID NO: 121160 - DNA, 78 bp, Homo sapiens; identical to SEQ ID NO: 89395
  chr22:37769566-37769644
  Hypo

SEQ ID NO: 121161 - DNA, 117 bp, Homo sapiens; identical to SEQ ID NO: 89396
  chr22:37769882-37769999
  Hypo

SEQ ID NO: 121162 - DNA, 30 bp, Homo sapiens; identical to SEQ ID NO: 46700
  chr22:37770782-37770812
  Hypo

SEQ ID NO: 121163 - DNA, 318 bp, Homo sapiens; identical to SEQ ID NO: 89398
  chr22:37816014-37816332
  Hyper

SEQ ID NO: 121164 - DNA, 35 bp, Homo sapiens; identical to SEQ ID NO: 89399
  chr22:37816789-37816824
  Hyper

SEQ ID NO: 121165 - DNA, 30 bp, Homo sapiens; identical to SEQ ID NO: 89400
  chr22:37823354-37823384
  Hyper

SEQ ID NO: 121166 - DNA, 356 bp, Homo sapiens; identical to SEQ ID NO: 89401
  chr22:37823590-37823946
  Hyper

SEQ ID NO: 121167 - DNA, 30 bp, Homo sapiens; identical to SEQ ID NO: 89402
  chr22:37845091-37845121
  Hypo

SEQ ID NO: 121168 - DNA, 54 bp, Homo sapiens; identical to SEQ ID NO: 89403
  chr22:37914879-37914933
  Hyper

SEQ ID NO: 121169 - DNA, 97 bp, Homo sapiens; identical to SEQ ID NO: 89404
  chr22:38002842-38002939
  Hypo

SEQ ID NO: 121170 - DNA, 30 bp, Homo sapiens; identical to SEQ ID NO: 89405
  chr22:38030040-38030070
  Hyper

SEQ ID NO: 121171 - DNA, 40 bp, Homo sapiens; identical to SEQ ID NO: 89406
  chr22:38064571-38064611
  Hypo

SEQ ID NO: 121172 - DNA, 82 bp, Homo sapiens; identical to SEQ ID NO: 89407
  chr22:38081717-38081799
  Hypo

SEQ ID NO: 121173 - DNA, 144 bp, Homo sapiens; identical to SEQ ID NO: 89408
  chr22:38085121-38085265
  Hypo

SEQ ID NO: 121174 - DNA, 80 bp, Homo sapiens; identical to SEQ ID NO: 89409
  chr22:38122369-38122449
  Hypo

SEQ ID NO: 121175 - DNA, 30 bp, Homo sapiens; identical to SEQ ID NO: 89410
  chr22:38138874-38138904
  Hypo

SEQ ID NO: 121176 - DNA, 324 bp, Homo sapiens; identical to SEQ ID NO: 89411
  chr22:38199680-38200004
  Hypo

SEQ ID NO: 121177 - DNA, 33 bp, Homo sapiens; identical to SEQ ID NO: 89412
  chr22:38214652-38214685
  Hyper

SEQ ID NO: 121178 - DNA, 772 bp, Homo sapiens; identical to SEQ ID NO: 89413
  chr22:38220595-38221367
  Hyper

SEQ ID NO: 121179 - DNA, 190 bp, Homo sapiens; identical to SEQ ID NO: 89414
  chr22:38339567-38339757
  Hypo

SEQ ID NO: 121180 - DNA, 116 bp, Homo sapiens; identical to SEQ ID NO: 89415
  chr22:38380321-38380437
  Hypo

SEQ ID NO: 121181 - DNA, 30 bp, Homo sapiens; identical to SEQ ID NO: 89416
  chr22:38434976-38435006
  Hypo

SEQ ID NO: 121182 - DNA, 883 bp, Homo sapiens
  chr22:38476933-38477816
  Hyper
ccgccatgagcacctcgaactgcagcgcgcccaccatgccgtaggagaggccgaaggcgacgcagaaggcgacgagggcgccgtaggagcgcgcgcgtgcgctgctcaggtctgtgagcccattggccagcagggccaggctgaacagatacgggacgtgcggccgcagacgcgccaggcccgccagggcgccgcacgccgggcgcgccacgatgtccacgaagcccacgatggacagcaggaaggcggcgtcggtgtcgggcacgcccgcgtccttggcgtagttcaccagcaggatggcggggacgaagagcccgagcgccatcaggaacttggtgacggcgtacacggcgaaggcgcggtcggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaagactgtccctc

SEQ ID NO: 121183 - DNA, 223 bp, Homo sapiens
  chr22:38478409-38478632
  Hyper
tgcctctacaatgggcgggtgtggtcttagaaggggccctctgagctcgcagggcagccccctgggccggccccgcctctggccgctgtctccctcccgccctctcttcccctctttctggtgccagggttcccacaggcaggaagggacttcgggggccaccccgagggtcagggggatgctcaggggctcgggtgtctcctggttccggatcccaggggtc

SEQ ID NO: 121184 - DNA, 30 bp, Homo sapiens; identical to SEQ ID NO: 89420
  chr22:38482327-38482357
  Hypo

SEQ ID NO: 121185 - DNA, 47 bp, Homo sapiens; identical to SEQ ID NO: 89421
  chr22:38507636-38507683
  Hypo

SEQ ID NO: 121186 - DNA, 131 bp, Homo sapiens; identical to SEQ ID NO: 89422
  chr22:38516843-38516974
  Hypo

SEQ ID NO: 121187 - DNA, 176 bp, Homo sapiens; identical to SEQ ID NO: 89423
  chr22:38520276-38520452
  Hypo

SEQ ID NO: 121188 - DNA, 84 bp, Homo sapiens; identical to SEQ ID NO: 46704
  chr22:38578330-38578414
  Hypo

SEQ ID NO: 121189 - DNA, 24 bp, Homo sapiens
  chr22:38578714-38578738
  Hypo
gcccggctccgaaatttttaacat

SEQ ID NO: 121190 - DNA, 96 bp, Homo sapiens; identical to SEQ ID NO: 89426
  chr22:38592952-38593048
  Hypo

SEQ ID NO: 121191 - DNA, 30 bp, Homo sapiens; identical to SEQ ID NO: 89427
  chr22:38639203-38639233
  Hypo

SEQ ID NO: 121192 - DNA, 136 bp, Homo sapiens; identical to SEQ ID NO: 46706
  chr22:38679362-38679498
  Hypo

SEQ ID NO: 121193 - DNA, 38 bp, Homo sapiens; identical to SEQ ID NO: 89429
  chr22:38687259-38687297
  Hypo

SEQ ID NO: 121194 - DNA, 148 bp, Homo sapiens; identical to SEQ ID NO: 89430
  chr22:38694445-38694593
  Hypo

SEQ ID NO: 121195 - DNA, 33 bp, Homo sapiens; identical to SEQ ID NO: 89431
  chr22:38841842-38841875
  Hypo

SEQ ID NO: 121196 - DNA, 91 bp, Homo sapiens; identical to SEQ ID NO: 89432
  chr22:38843208-38843299
  Hypo

SEQ ID NO: 121197 - DNA, 547 bp, Homo sapiens; identical to SEQ ID NO: 89433
  chr22:38850751-38851298
  Hyper

SEQ ID NO: 121198 - DNA, 148 bp, Homo sapiens; identical to SEQ ID NO: 89434
  chr22:38851520-38851668
  Hyper

SEQ ID NO: 121199 - DNA, 30 bp, Homo sapiens; identical to SEQ ID NO: 89435
  chr22:38864955-38864985
  Hypo

SEQ ID NO: 121200 - DNA, 138 bp, Homo sapiens; identical to SEQ ID NO: 89436
  chr22:38965908-38966046
  Hyper

SEQ ID NO: 121201 - DNA, 17 bp, Homo sapiens
  chr22:39097903-39097920
  Hypo
ttggagacggagtttcg

SEQ ID NO: 121202 - DNA, 39 bp, Homo sapiens; identical to SEQ ID NO: 89438
  chr22:39098887-39098926
  Hypo

SEQ ID NO: 121203 - DNA, 30 bp, Homo sapiens; identical to SEQ ID NO: 89439
  chr22:39150522-39150552
  Hyper

SEQ ID NO: 121204 - DNA, 30 bp, Homo sapiens; identical to SEQ ID NO: 89440
  chr22:39227742-39227772
  Hypo

SEQ ID NO: 121205 - DNA, 30 bp, Homo sapiens; identical to SEQ ID NO: 46709
  chr22:39228205-39228235
  Hypo

SEQ ID NO: 121206 - DNA, 66 bp, Homo sapiens; identical to SEQ ID NO: 89442
  chr22:39239346-39239412
  Hyper

SEQ ID NO: 121207 - DNA, 30 bp, Homo sapiens; identical to SEQ ID NO: 89443
  chr22:39256879-39256909
  Hypo

SEQ ID NO: 121208 - DNA, 30 bp, Homo sapiens; identical to SEQ ID NO: 89444
  chr22:39370509-39370539
  Hypo

SEQ ID NO: 121209 - DNA, 35 bp, Homo sapiens; identical to SEQ ID NO: 89445
  chr22:39413652-39413687
  Hypo

SEQ ID NO: 121210 - DNA, 30 bp, Homo sapiens; identical to SEQ ID NO: 89446
  chr22:39427969-39427999
  Hypo

SEQ ID NO: 121211 - DNA, 34 bp, Homo sapiens; identical to SEQ ID NO: 89447
  chr22:39435689-39435723
  Hypo

SEQ ID NO: 121212 - DNA, 168 bp, Homo sapiens; identical to SEQ ID NO: 89448
  chr22:39473204-39473372
  Hyper

SEQ ID NO: 121213 - DNA, 40 bp, Homo sapiens; identical to SEQ ID NO: 89449
  chr22:39530973-39531013
  Hypo

SEQ ID NO: 121214 - DNA, 30 bp, Homo sapiens; identical to SEQ ID NO: 89450
  chr22:39531766-39531796
  Hypo

SEQ ID NO: 121215 - DNA, 85 bp, Homo sapiens; identical to SEQ ID NO: 89451
  chr22:39549387-39549472
  Hyper

SEQ ID NO: 121216 - DNA, 19 bp, Homo sapiens
  chr22:39551428-39551447
  Hypo
gccacggaagaggtacgtt

SEQ ID NO: 121217 - DNA, 66 bp, Homo sapiens; identical to SEQ ID NO: 89453
  chr22:39639644-39639710
  Hyper

SEQ ID NO: 121218 - DNA, 110 bp, Homo sapiens; identical to SEQ ID NO: 89454
  chr22:39680042-39680152
  Hypo

SEQ ID NO: 121219 - DNA, 30 bp, Homo sapiens; identical to SEQ ID NO: 89455
  chr22:39690071-39690101
  Hypo

SEQ ID NO: 121220 - DNA, 31 bp, Homo sapiens; identical to SEQ ID NO: 89456
  chr22:39716831-39716862
  Hypo

SEQ ID NO: 121221 - DNA, 30 bp, Homo sapiens; identical to SEQ ID NO: 89457
  chr22:39735204-39735234
  Hypo

SEQ ID NO: 121222 - DNA, 342 bp, Homo sapiens; identical to SEQ ID NO: 89458
  chr22:39745777-39746119
  Hyper

SEQ ID NO: 121223 - DNA, 140 bp, Homo sapiens; identical to SEQ ID NO: 89459
  chr22:39746397-39746537
  Hyper

SEQ ID NO: 121224 - DNA, 182 bp, Homo sapiens; identical to SEQ ID NO: 46711
  chr22:39756856-39757038
  Hypo

SEQ ID NO: 121225 - DNA, 166 bp, Homo sapiens; identical to SEQ ID NO: 89461
  chr22:39770472-39770638
  Hypo

SEQ ID NO: 121226 - DNA, 196 bp, Homo sapiens; identical to SEQ ID NO: 89462
  chr22:39784299-39784495
  Hyper

SEQ ID NO: 121227 - DNA, 34 bp, Homo sapiens; identical to SEQ ID NO: 89463
  chr22:39830355-39830389
  Hypo

SEQ ID NO: 121228 - DNA, 66 bp, Homo sapiens; identical to SEQ ID NO: 38552
  chr22:39853091-39853157
  Hyper

SEQ ID NO: 121229 - DNA, 244 bp, Homo sapiens
  chr22:39853382-39853626
  Hyper
gggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggtgagttgaccccggcgtcctggggggcgccgcggcccctctatccccgcgctgcccgccctcc

SEQ ID NO: 121230 - DNA, 35 bp, Homo sapiens; identical to SEQ ID NO: 89467
  chr22:39853899-39853934
  Hyper

SEQ ID NO: 121231 - DNA, 151 bp, Homo sapiens; identical to SEQ ID NO: 89468
  chr22:39854212-39854363
  Hyper

SEQ ID NO: 121232 - DNA, 210 bp, Homo sapiens; identical to SEQ ID NO: 89469
  chr22:39877226-39877436
  Hypo

SEQ ID NO: 121233 - DNA, 30 bp, Homo sapiens; identical to SEQ ID NO: 46714
  chr22:39932533-39932563
  Hypo

SEQ ID NO: 121234 - DNA, 48 bp, Homo sapiens; identical to SEQ ID NO: 89471
  chr22:39942097-39942145
  Hyper

SEQ ID NO: 121235 - DNA, 687 bp, Homo sapiens
  chr22:39953464-39954151
  Hyper
tgtctgtcgcctccacgcctcccccctccagcgtcccgcgcctgcagctttccccgaagacatttggtgtcagtataaggacggcttttcctcgcacgcagcgcggctcggtctcgccgccgccgcacgtccccgcaccgccaggcgctcgggctcctccgcagcccccgccgcgcgcagaccccgcgcttcgagccctgagccggaggcgcgagcagagccgaggcaggcgagagaccggcctcagccccgcgctccccgccgcgctggtctctcccgggcacttgccccgctgctcggtccccgcagcacccgcgcccccgccccggcccggagcgccgcgctcccgcccgccgcccgcccagagcctcgccgtccctccagcccgccgcctcctcctcctcccgccatggcccgggcccccgggcccgccgccccccgcccgccgccccccgcgccccgggggctcagctgatcctgaattggcggggggtcggctggcggggctgggggtccctctcgatcgccggcttcgggtggggacgcgttgtccccgcgtctctaacctggacgaccccccgcggccgggccacgtccatgccaaggtaggtgggggctgggtgggtggggggaaggaagggagggcttcgcttcgatgccagtttcttggcgcgttggcttctctct

SEQ ID NO: 121236 - DNA, 209 bp, Homo sapiens
  chr22:39954397-39954606
  Hyper
gtccggccgcccctccgcggctgcggctctgcgggcagctgggccagagctggtgcccgtgtccggcgggctgagctgggagcgctggcctgggagcgcggcagcgggggccactggatgggggaatcccgggcagggtttaactttcccggaggcgggggtggcggagaccccccctttggctggcaccccagcggggcggaggcctc

SEQ ID NO: 121237 - DNA, 30 bp, Homo sapiens; identical to SEQ ID NO: 89477
  chr22:39994870-39994900
  Hypo

SEQ ID NO: 121238 - DNA, 30 bp, Homo sapiens; identical to SEQ ID NO: 89478
  chr22:40014407-40014437
  Hypo

SEQ ID NO: 121239 - DNA, 323 bp, Homo sapiens; identical to SEQ ID NO: 89479
  chr22:40014919-40015242
  Hypo

SEQ ID NO: 121240 - DNA, 206 bp, Homo sapiens; identical to SEQ ID NO: 46715
  chr22:40018133-40018339
  Hypo

SEQ ID NO: 121241 - DNA, 75 bp, Homo sapiens; identical to SEQ ID NO: 89481
  chr22:40037009-40037084
  Hypo

SEQ ID NO: 121242 - DNA, 354 bp, Homo sapiens; identical to SEQ ID NO: 89482
  chr22:40042546-40042900
  Hypo

SEQ ID NO: 121243 - DNA, 68 bp, Homo sapiens; identical to SEQ ID NO: 89483
  chr22:40055020-40055088
  Hypo

SEQ ID NO: 121244 - DNA, 53 bp, Homo sapiens; identical to SEQ ID NO: 89484
  chr22:40055554-40055607
  Hypo

SEQ ID NO: 121245 - DNA, 36 bp, Homo sapiens; identical to SEQ ID NO: 89485
  chr22:40060586-40060622
  Hyper

SEQ ID NO: 121246 - DNA, 36 bp, Homo sapiens; identical to SEQ ID NO: 89486
  chr22:40069714-40069750
  Hypo

SEQ ID NO: 121247 - DNA, 148 bp, Homo sapiens; identical to SEQ ID NO: 89487
  chr22:40073967-40074115
  Hypo

SEQ ID NO: 121248 - DNA, 39 bp, Homo sapiens; identical to SEQ ID NO: 89488
  chr22:40075188-40075227
  Hypo

SEQ ID NO: 121249 - DNA, 276 bp, Homo sapiens
  chr22:40081776-40082052
  Hyper
cgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggaccc

SEQ ID NO: 121250 - DNA, 235 bp, Homo sapiens; identical to SEQ ID NO: 89490
  chr22:40095526-40095761
  Hypo

SEQ ID NO: 121251 - DNA, 32 bp, Homo sapiens; identical to SEQ ID NO: 89491
  chr22:40111009-40111041
  Hypo

SEQ ID NO: 121252 - DNA, 30 bp, Homo sapiens; identical to SEQ ID NO: 46722
  chr22:40113507-40113537
  Hypo

SEQ ID NO: 121253 - DNA, 75 bp, Homo sapiens; identical to SEQ ID NO: 89493
  chr22:40215378-40215453
  Hypo

SEQ ID NO: 121254 - DNA, 137 bp, Homo sapiens; identical to SEQ ID NO: 89494
  chr22:40226362-40226499
  Hypo

SEQ ID NO: 121255 - DNA, 171 bp, Homo sapiens; identical to SEQ ID NO: 89495
  chr22:40367623-40367794
  Hypo

SEQ ID NO: 121256 - DNA, 30 bp, Homo sapiens; identical to SEQ ID NO: 89496
  chr22:40368168-40368198
  Hypo

SEQ ID NO: 121257 - DNA, 226 bp, Homo sapiens; identical to SEQ ID NO: 89497
  chr22:40390429-40390655
  Hyper

SEQ ID NO: 121258 - DNA, 172 bp, Homo sapiens; identical to SEQ ID NO: 89498
  chr22:40417456-40417628
  Hypo

SEQ ID NO: 121259 - DNA, 78 bp, Homo sapiens; identical to SEQ ID NO: 89499
  chr22:40548259-40548337
  Hypo

SEQ ID NO: 121260 - DNA, 30 bp, Homo sapiens; identical to SEQ ID NO: 89500
  chr22:40815121-40815151
  Hypo

SEQ ID NO: 121261 - DNA, 37 bp, Homo sapiens; identical to SEQ ID NO: 89501
  chr22:40991442-40991479
  Hypo

SEQ ID NO: 121262 - DNA, 45 bp, Homo sapiens; identical to SEQ ID NO: 89502
  chr22:41034525-41034570
  Hypo

SEQ ID NO: 121263 - DNA, 67 bp, Homo sapiens
  chr22:41048451-41048518
  Hypo
cccacaccccagcaccggggagcgccccagggctccgctgtggcctgccctgcggctggcaggccat

SEQ ID NO: 121264 - DNA, 221 bp, Homo sapiens; identical to SEQ ID NO: 89503
  chr22:41048732-41048953
  Hypo

SEQ ID NO: 121265 - DNA, 35 bp, Homo sapiens; identical to SEQ ID NO: 89504
  chr22:41398391-41398426
  Hypo

SEQ ID NO: 121266 - DNA, 82 bp, Homo sapiens; identical to SEQ ID NO: 89505
  chr22:41578498-41578580
  Hypo

SEQ ID NO: 121267 - DNA, 444 bp, Homo sapiens; identical to SEQ ID NO: 46727
  chr22:41634411-41634855
  Hypo

SEQ ID NO: 121268 - DNA, 97 bp, Homo sapiens; identical to SEQ ID NO: 89507
  chr22:41637099-41637196
  Hypo

SEQ ID NO: 121269 - DNA, 101 bp, Homo sapiens; identical to SEQ ID NO: 46729
  chr22:41657315-41657416
  Hypo

SEQ ID NO: 121270 - DNA, 71 bp, Homo sapiens; identical to SEQ ID NO: 89509
  chr22:41668097-41668168
  Hypo

SEQ ID NO: 121271 - DNA, 22 bp, Homo sapiens
  chr22:41690045-41690067
  Hypo
ctctccctctccccacggtctc

SEQ ID NO: 121272 - DNA, 30 bp, Homo sapiens; identical to SEQ ID NO: 89511
  chr22:41762483-41762513
  Hypo

SEQ ID NO: 121273 - DNA, 33 bp, Homo sapiens; identical to SEQ ID NO: 89512
  chr22:41776124-41776157
  Hypo

SEQ ID NO: 121274 - DNA, 81 bp, Homo sapiens; identical to SEQ ID NO: 46732
  chr22:41839301-41839382
  Hypo

SEQ ID NO: 121275 - DNA, 21 bp, Homo sapiens
  chr22:41839922-41839943
  Hypo
cccggccggaaggtttttcag

SEQ ID NO: 121276 - DNA, 39 bp, Homo sapiens; identical to SEQ ID NO: 89515
  chr22:41939338-41939377
  Hypo

SEQ ID NO: 121277 - DNA, 83 bp, Homo sapiens; identical to SEQ ID NO: 89516
  chr22:41995514-41995597
  Hypo

SEQ ID NO: 121278 - DNA, 165 bp, Homo sapiens; identical to SEQ ID NO: 89517
  chr22:42096088-42096253
  Hypo

SEQ ID NO: 121279 - DNA, 42 bp, Homo sapiens; identical to SEQ ID NO: 46735
  chr22:42109080-42109122
  Hypo

SEQ ID NO: 121280 - DNA, 575 bp, Homo sapiens; identical to SEQ ID NO: 89519
  chr22:42306066-42306641
  Hyper

SEQ ID NO: 121281 - DNA, 395 bp, Homo sapiens
  chr22:42306872-42307267
  Hyper
ggaacagaacccagacggggcgtgggggctgccaagcctgcctgcctctcgagagacccagggggaggctctggagcccgagcctcagatcacagccccggccagcaaatcctgcatctggaaccttcctcacacatcacagccccccagactcgaggccgcaggacccgtggggggtccctttccaccctggcgagctggctggccggtcgggcccctcacccgcagaggccgcggctcatttccaccggggaagcctctatgccccagccgagggaccgcctctcggcctctcacgcccctccgcgtgctccgccgccgctcagccccgcccgccaccgactcacctgcgctgttgtggggggagccccgggggaggccgtcccccatctgca

SEQ ID NO: 121282 - DNA, 924 bp, Homo sapiens; identical to SEQ ID NO: 89522
  chr22:42310042-42310966
  Hyper

SEQ ID NO: 121283 - DNA, 297 bp, Homo sapiens; identical to SEQ ID NO: 89523
  chr22:42311316-42311613
  Hyper

SEQ ID NO: 121284 - DNA, 100 bp, Homo sapiens; identical to SEQ ID NO: 89524
  chr22:42315581-42315681
  Hyper

SEQ ID NO: 121285 - DNA, 59 bp, Homo sapiens; identical to SEQ ID NO: 89525
  chr22:42315890-42315949
  Hyper

SEQ ID NO: 121286 - DNA, 65 bp, Homo sapiens; identical to SEQ ID NO: 89526
  chr22:42322145-42322210
  Hyper

SEQ ID NO: 121287 - DNA, 32 bp, Homo sapiens; identical to SEQ ID NO: 89527
  chr22:42322723-42322755
  Hyper

SEQ ID NO: 121288 - DNA, 451 bp, Homo sapiens; identical to SEQ ID NO: 38566
  chr22:42353573-42354024
  Hyper

SEQ ID NO: 121289 - DNA, 120 bp, Homo sapiens; identical to SEQ ID NO: 89529
  chr22:42367935-42368055
  Hypo

SEQ ID NO: 121290 - DNA, 129 bp, Homo sapiens; identical to SEQ ID NO: 89530
  chr22:42373203-42373332
  Hyper

SEQ ID NO: 121291 - DNA, 140 bp, Homo sapiens; identical to SEQ ID NO: 89531
  chr22:42395150-42395290
  Hypo

SEQ ID NO: 121292 - DNA, 54 bp, Homo sapiens; identical to SEQ ID NO: 89532
  chr22:42470162-42470216
  Hyper

SEQ ID NO: 121293 - DNA, 244 bp, Homo sapiens; identical to SEQ ID NO: 89533
  chr22:42667169-42667413
  Hypo

SEQ ID NO: 121294 - DNA, 30 bp, Homo sapiens; identical to SEQ ID NO: 46738
  chr22:42675831-42675861
  Hypo

SEQ ID NO: 121295 - DNA, 796 bp, Homo sapiens
  chr22:42679388-42680184
  Hyper
cggaggggacgggggcgcggctggatctggaccggaggggacgggggcgggcactcggcccctgggactgtgacccggggccctgcccttcacgcccctgctgctgccgcgctccccgagcagccccctcgggcccctcctctcccggccaccctcctgggcactgctctgaacatcccccgcctccccgccctccatcgctctttatggcagtttcaaagctacagccgccactcgagcagctgcggcctttgatggggacaaggcagtaaaggccgcccgggaggcccctgcccagccctgccctggcccggcgcggcccctgcccgcccccggggagcctcgggccagggcagcgcggcgcggcggagcacccggcgggcacgcctcgcacgccagagcaaactttcacgaccgcgggagaggcaccgcgcacaccgttacctttgcagccgcatccttccctggcccttgccccagaccccttgccagcccggcgaccacgggggaggaaaacaactcctgagccgaggcgggggaggaggggaaagggaaaaaaggagaaggaaaaggaaaggggggcagtttctcggctctcagcctcctcgcggctcctcctgcccaagccggcaagtgaagtcacagggccggggcggtgacatcagctgagcctctgacatcacggcccctgccgatctcacctctgcagggtggagatggaggagcagcggggaggagggatggatggatggaggagggaggggagcacccgatcccccctcgccttcaactgcgg

SEQ ID NO: 121296 - DNA, 152 bp, Homo sapiens; identical to SEQ ID NO: 89537
  chr22:42695951-42696103
  Hyper

SEQ ID NO: 121297 - DNA, 30 bp, Homo sapiens; identical to SEQ ID NO: 89538
  chr22:42697866-42697896
  Hypo

SEQ ID NO: 121298 - DNA, 185 bp, Homo sapiens; identical to SEQ ID NO: 89539
  chr22:42829925-42830110
  Hypo

SEQ ID NO: 121299 - DNA, 204 bp, Homo sapiens; identical to SEQ ID NO: 89540
  chr22:42896511-42896715
  Hyper

SEQ ID NO: 121300 - DNA, 42 bp, Homo sapiens; identical to SEQ ID NO: 89541
  chr22:42916273-42916315
  Hypo

SEQ ID NO: 121301 - DNA, 36 bp, Homo sapiens; identical to SEQ ID NO: 89542
  chr22:42944631-42944667
  Hypo

SEQ ID NO: 121302 - DNA, 74 bp, Homo sapiens; identical to SEQ ID NO: 89543
  chr22:42963239-42963313
  Hypo

SEQ ID NO: 121303 - DNA, 19 bp, Homo sapiens
  chr22:42995312-42995331
  Hypo
gaaaggctctattcacgcc

SEQ ID NO: 121304 - DNA, 30 bp, Homo sapiens; identical to SEQ ID NO: 16790
  chr22:42995705-42995735
  Hypo

SEQ ID NO: 121305 - DNA, 103 bp, Homo sapiens; identical to SEQ ID NO: 89546
  chr22:43012479-43012582
  Hypo

SEQ ID NO: 121306 - DNA, 102 bp, Homo sapiens; identical to SEQ ID NO: 89547
  chr22:43012882-43012984
  Hypo

SEQ ID NO: 121307 - DNA, 50 bp, Homo sapiens; identical to SEQ ID NO: 89548
  chr22:43033683-43033733
  Hypo

SEQ ID NO: 121308 - DNA, 140 bp, Homo sapiens; identical to SEQ ID NO: 89549
  chr22:43083005-43083145
  Hypo

SEQ ID NO: 121309 - DNA, 208 bp, Homo sapiens; identical to SEQ ID NO: 89550
  chr22:43116061-43116269
  Hyper

SEQ ID NO: 121310 - DNA, 30 bp, Homo sapiens; identical to SEQ ID NO: 89551
  chr22:43265859-43265889
  Hypo

SEQ ID NO: 121311 - DNA, 169 bp, Homo sapiens; identical to SEQ ID NO: 89552
  chr22:43434409-43434578
  Hypo

SEQ ID NO: 121312 - DNA, 25 bp, Homo sapiens
  chr22:43484637-43484662
  Hypo
cgtgcccggccggggcccatctttt

SEQ ID NO: 121313 - DNA, 203 bp, Homo sapiens; identical to SEQ ID NO: 89554
  chr22:43523306-43523509
  Hypo

SEQ ID NO: 121314 - DNA, 77 bp, Homo sapiens; identical to SEQ ID NO: 89555
  chr22:43524552-43524629
  Hypo

SEQ ID NO: 121315 - DNA, 194 bp, Homo sapiens; identical to SEQ ID NO: 46745
  chr22:43524923-43525117
  Hypo

SEQ ID NO: 121316 - DNA, 60 bp, Homo sapiens; identical to SEQ ID NO: 89557
  chr22:43528378-43528438
  Hypo

SEQ ID NO: 121317 - DNA, 30 bp, Homo sapiens; identical to SEQ ID NO: 89558
  chr22:43553497-43553527
  Hypo

SEQ ID NO: 121318 - DNA, 67 bp, Homo sapiens; identical to SEQ ID NO: 89559
  chr22:43570247-43570314
  Hypo

SEQ ID NO: 121319 - DNA, 43 bp, Homo sapiens; identical to SEQ ID NO: 89560
  chr22:43571286-43571329
  Hypo

SEQ ID NO: 121320 - DNA, 30 bp, Homo sapiens; identical to SEQ ID NO: 16795
  chr22:43581330-43581360
  Hypo

SEQ ID NO: 121321 - DNA, 36 bp, Homo sapiens; identical to SEQ ID NO: 89562
  chr22:43581591-43581627
  Hypo

SEQ ID NO: 121322 - DNA, 30 bp, Homo sapiens; identical to SEQ ID NO: 89563
  chr22:43584877-43584907
  Hypo

SEQ ID NO: 121323 - DNA, 39 bp, Homo sapiens; identical to SEQ ID NO: 89564
  chr22:43593004-43593043
  Hypo

SEQ ID NO: 121324 - DNA, 398 bp, Homo sapiens; identical to SEQ ID NO: 89565
  chr22:43600957-43601355
  Hypo

SEQ ID NO: 121325 - DNA, 202 bp, Homo sapiens; identical to SEQ ID NO: 46749
  chr22:43603869-43604071
  Hypo

SEQ ID NO: 121326 - DNA, 30 bp, Homo sapiens; identical to SEQ ID NO: 89567
  chr22:43608657-43608687
  Hypo

SEQ ID NO: 121327 - DNA, 30 bp, Homo sapiens; identical to SEQ ID NO: 89568
  chr22:43641411-43641441
  Hypo

SEQ ID NO: 121328 - DNA, 30 bp, Homo sapiens; identical to SEQ ID NO: 89569
  chr22:43655786-43655816
  Hypo

SEQ ID NO: 121329 - DNA, 92 bp, Homo sapiens; identical to SEQ ID NO: 89570
  chr22:43665077-43665169
  Hypo

SEQ ID NO: 121330 - DNA, 167 bp, Homo sapiens; identical to SEQ ID NO: 89571
  chr22:43677829-43677996
  Hypo

SEQ ID NO: 121331 - DNA, 30 bp, Homo sapiens; identical to SEQ ID NO: 89572
  chr22:43687676-43687706
  Hypo

SEQ ID NO: 121332 - DNA, 343 bp, Homo sapiens; identical to SEQ ID NO: 89573
  chr22:43689396-43689739
  Hypo

SEQ ID NO: 121333 - DNA, 30 bp, Homo sapiens; identical to SEQ ID NO: 89574
  chr22:43705089-43705119
  Hypo

SEQ ID NO: 121334 - DNA, 30 bp, Homo sapiens; identical to SEQ ID NO: 46753
  chr22:43735330-43735360
  Hypo

SEQ ID NO: 121335 - DNA, 30 bp, Homo sapiens; identical to SEQ ID NO: 89576
  chr22:43738298-43738328
  Hyper

SEQ ID NO: 121336 - DNA, 114 bp, Homo sapiens; identical to SEQ ID NO: 89577
  chr22:43738536-43738650
  Hyper

SEQ ID NO: 121337 - DNA, 1182 bp, Homo sapiens
  chr22:43738979-43740161
  Hyper
cggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgtcgtcggggggacccttcccctggggcgggcggcaggtggggggtgtgggcctggccggccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacgcgccagcgcgcagagcagactcgcctgcgctgccgtttgctggacgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggag

SEQ ID NO: 121338 - DNA, 81 bp, Homo sapiens; identical to SEQ ID NO: 89582
  chr22:43795778-43795859
  Hypo

SEQ ID NO: 121339 - DNA, 347 bp, Homo sapiens
  chr22:43807413-43807760
  Hyper
ggaccttccagaccccgggcgggaggggcccacagcagggtgccccggcggccccaggagggggtccgggcctcgggcgaaggctgcggcgccccggaaggagccgcgcacgcccctgcacgcggtgcccgctgcggaggccacggatccggaggtgagagcgcccccgccccgctccctgcccagcccgcgcgcggcccggtccggggctgggggcgggcgccaagaggggcgccgggcgcagtggggcggccccctcccttttccgcagcgcgggccccgctcctcctcccgcgtccaggcccgcggccgcgctccctgtccctccgcagcgggatgcggactcc

SEQ ID NO: 121340 - DNA, 170 bp, Homo sapiens; identical to SEQ ID NO: 89585
  chr22:43808237-43808407
  Hyper

SEQ ID NO: 121341 - DNA, 30 bp, Homo sapiens; identical to SEQ ID NO: 89586
  chr22:43898540-43898570
  Hypo

SEQ ID NO: 121342 - DNA, 44 bp, Homo sapiens; identical to SEQ ID NO: 89587
  chr22:44208519-44208563
  Hyper

SEQ ID NO: 121343 - DNA, 30 bp, Homo sapiens; identical to SEQ ID NO: 89588
  chr22:44235527-44235557
  Hypo

SEQ ID NO: 121344 - DNA, 30 bp, Homo sapiens; identical to SEQ ID NO: 89589
  chr22:44255795-44255825
  Hypo

SEQ ID NO: 121345 - DNA, 45 bp, Homo sapiens
  chr22:44257998-44258043
  Hyper
gcccagcagaagccccgggcgcgggcgcggcgtctacgcggccgc

SEQ ID NO: 121346 - DNA, 253 bp, Homo sapiens; identical to SEQ ID NO: 89591
  chr22:44258280-44258533
  Hyper

SEQ ID NO: 121347 - DNA, 91 bp, Homo sapiens; identical to SEQ ID NO: 89592
  chr22:44263881-44263972
  Hyper

SEQ ID NO: 121348 - DNA, 478 bp, Homo sapiens; identical to SEQ ID NO: 89593
  chr22:44287444-44287922
  Hyper

SEQ ID NO: 121349 - DNA, 741 bp, Homo sapiens
  chr22:44319733-44320474
  Hyper
gccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttcc

SEQ ID NO: 121350 - DNA, 104 bp, Homo sapiens; identical to SEQ ID NO: 89596
  chr22:44419815-44419919
  Hyper

SEQ ID NO: 121351 - DNA, 202 bp, Homo sapiens; identical to SEQ ID NO: 89597
  chr22:44420478-44420680
  Hyper

SEQ ID NO: 121352 - DNA, 30 bp, Homo sapiens; identical to SEQ ID NO: 89598
  chr22:44440960-44440990
  Hypo

SEQ ID NO: 121353 - DNA, 30 bp, Homo sapiens; identical to SEQ ID NO: 89599
  chr22:44451937-44451967
  Hypo

SEQ ID NO: 121354 - DNA, 237 bp, Homo sapiens; identical to SEQ ID NO: 89600
  chr22:44455600-44455837
  Hypo

SEQ ID NO: 121355 - DNA, 37 bp, Homo sapiens; identical to SEQ ID NO: 89601
  chr22:44456975-44457012
  Hypo

SEQ ID NO: 121356 - DNA, 30 bp, Homo sapiens; identical to SEQ ID NO: 89602
  chr22:44478056-44478086
  Hypo

SEQ ID NO: 121357 - DNA, 271 bp, Homo sapiens; identical to SEQ ID NO: 89603
  chr22:44484711-44484982
  Hypo

SEQ ID NO: 121358 - DNA, 30 bp, Homo sapiens; identical to SEQ ID NO: 89604
  chr22:44487778-44487808
  Hypo

SEQ ID NO: 121359 - DNA, 30 bp, Homo sapiens; identical to SEQ ID NO: 89605
  chr22:44490749-44490779
  Hypo

SEQ ID NO: 121360 - DNA, 30 bp, Homo sapiens; identical to SEQ ID NO: 89606
  chr22:44492533-44492563
  Hypo

SEQ ID NO: 121361 - DNA, 35 bp, Homo sapiens; identical to SEQ ID NO: 89607
  chr22:44493706-44493741
  Hypo

SEQ ID NO: 121362 - DNA, 30 bp, Homo sapiens; identical to SEQ ID NO: 89608
  chr22:44498119-44498149
  Hypo

SEQ ID NO: 121363 - DNA, 48 bp, Homo sapiens; identical to SEQ ID NO: 89609
  chr22:44500221-44500269
  Hypo

SEQ ID NO: 121364 - DNA, 30 bp, Homo sapiens; identical to SEQ ID NO: 89610
  chr22:44512205-44512235
  Hypo

SEQ ID NO: 121365 - DNA, 36 bp, Homo sapiens; identical to SEQ ID NO: 46756
  chr22:44527455-44527491
  Hypo

SEQ ID NO: 121366 - DNA, 39 bp, Homo sapiens; identical to SEQ ID NO: 16798
  chr22:44538737-44538776
  Hypo

SEQ ID NO: 121367 - DNA, 148 bp, Homo sapiens; identical to SEQ ID NO: 89613
  chr22:44547536-44547684
  Hypo

SEQ ID NO: 121368 - DNA, 361 bp, Homo sapiens; identical to SEQ ID NO: 89614
  chr22:44564136-44564497
  Hypo

SEQ ID NO: 121369 - DNA, 62 bp, Homo sapiens; identical to SEQ ID NO: 46760
  chr22:44580537-44580599
  Hypo

SEQ ID NO: 121370 - DNA, 202 bp, Homo sapiens; identical to SEQ ID NO: 89616
  chr22:44664405-44664607
  Hypo

SEQ ID NO: 121371 - DNA, 60 bp, Homo sapiens; identical to SEQ ID NO: 89617
  chr22:44671250-44671310
  Hypo

SEQ ID NO: 121372 - DNA, 124 bp, Homo sapiens; identical to SEQ ID NO: 89618
  chr22:44681378-44681502
  Hypo

SEQ ID NO: 121373 - DNA, 149 bp, Homo sapiens; identical to SEQ ID NO: 89619
  chr22:44698427-44698576
  Hypo

SEQ ID NO: 121374 - DNA, 30 bp, Homo sapiens; identical to SEQ ID NO: 89620
  chr22:44708919-44708949
  Hypo

SEQ ID NO: 121375 - DNA, 174 bp, Homo sapiens; identical to SEQ ID NO: 89621
  chr22:44715015-44715189
  Hypo

SEQ ID NO: 121376 - DNA, 345 bp, Homo sapiens
  chr22:44726709-44727054
  Hyper
ggatcaatgttgattcggccccggaggcgacagcggttccgcaggggccgcgcggcggaccaggacccaggggcacgcacttgggaggggtccttctacccgtcccctgcgctgcccagctgggacccccaggcccctctgggtccgcagcgtggccctcagtccccgtgcagcccgcacggggctcccagctcactgagctccccgactctgttcttggaagccagtcccccccttggacgcggattccggtcccggccgccgcgtcccggcgcggtgcgccccgaactgctctcttcggaacccagccccttcctctccaaggttcagcgaccccgaccttgg

SEQ ID NO: 121377 - DNA, 890 bp, Homo sapiens; identical to SEQ ID NO: 89623
  chr22:44727361-44728251
  Hyper

SEQ ID NO: 121378 - DNA, 30 bp, Homo sapiens; identical to SEQ ID NO: 89624
  chr22:44765215-44765245
  Hypo

SEQ ID NO: 121379 - DNA, 30 bp, Homo sapiens; identical to SEQ ID NO: 89625
  chr22:44782734-44782764
  Hypo

SEQ ID NO: 121380 - DNA, 862 bp, Homo sapiens; identical to SEQ ID NO: 89626
  chr22:44892516-44893378
  Hypo

SEQ ID NO: 121381 - DNA, 144 bp, Homo sapiens; identical to SEQ ID NO: 89627
  chr22:45004252-45004396
  Hypo

SEQ ID NO: 121382 - DNA, 303 bp, Homo sapiens; identical to SEQ ID NO: 89628
  chr22:45016198-45016501
  Hyper

SEQ ID NO: 121383 - DNA, 150 bp, Homo sapiens; identical to SEQ ID NO: 89629
  chr22:45020626-45020776
  Hypo

SEQ ID NO: 121384 - DNA, 77 bp, Homo sapiens; identical to SEQ ID NO: 89630
  chr22:45064126-45064203
  Hyper

SEQ ID NO: 121385 - DNA, 243 bp, Homo sapiens; identical to SEQ ID NO: 89631
  chr22:45064675-45064918
  Hyper

SEQ ID NO: 121386 - DNA, 163 bp, Homo sapiens; identical to SEQ ID NO: 46766
  chr22:45075725-45075888
  Hypo

SEQ ID NO: 121387 - DNA, 30 bp, Homo sapiens; identical to SEQ ID NO: 89633
  chr22:45085002-45085032
  Hypo

SEQ ID NO: 121388 - DNA, 30 bp, Homo sapiens; identical to SEQ ID NO: 89634
  chr22:45087165-45087195
  Hypo

SEQ ID NO: 121389 - DNA, 156 bp, Homo sapiens; identical to SEQ ID NO: 89635
  chr22:45088610-45088766
  Hypo

SEQ ID NO: 121390 - DNA, 133 bp, Homo sapiens; identical to SEQ ID NO: 89636
  chr22:45093092-45093225
  Hypo

SEQ ID NO: 121391 - DNA, 51 bp, Homo sapiens; identical to SEQ ID NO: 89637
  chr22:45098330-45098381
  Hyper

SEQ ID NO: 121392 - DNA, 49 bp, Homo sapiens; identical to SEQ ID NO: 89638
  chr22:45098851-45098900
  Hyper

SEQ ID NO: 121393 - DNA, 132 bp, Homo sapiens; identical to SEQ ID NO: 89639
  chr22:45120626-45120758
  Hypo

SEQ ID NO: 121394 - DNA, 22 bp, Homo sapiens
  chr22:45129859-45129881
  Hypo
gtacctgggtgtggccgggtgc

SEQ ID NO: 121395 - DNA, 40 bp, Homo sapiens; identical to SEQ ID NO: 89641
  chr22:45135939-45135979
  Hypo

SEQ ID NO: 121396 - DNA, 99 bp, Homo sapiens; identical to SEQ ID NO: 89642
  chr22:45137823-45137922
  Hypo

SEQ ID NO: 121397 - DNA, 213 bp, Homo sapiens; identical to SEQ ID NO: 89643
  chr22:45148657-45148870
  Hyper

SEQ ID NO: 121398 - DNA, 30 bp, Homo sapiens; identical to SEQ ID NO: 89644
  chr22:45218482-45218512
  Hypo

SEQ ID NO: 121399 - DNA, 162 bp, Homo sapiens; identical to SEQ ID NO: 89645
  chr22:45259666-45259828
  Hypo

SEQ ID NO: 121400 - DNA, 351 bp, Homo sapiens; identical to SEQ ID NO: 89646
  chr22:45277170-45277521
  Hypo

SEQ ID NO: 121401 - DNA, 30 bp, Homo sapiens; identical to SEQ ID NO: 89647
  chr22:45289175-45289205
  Hypo

SEQ ID NO: 121402 - DNA, 30 bp, Homo sapiens; identical to SEQ ID NO: 89648
  chr22:45304141-45304171
  Hypo

SEQ ID NO: 121403 - DNA, 30 bp, Homo sapiens; identical to SEQ ID NO: 89649
  chr22:45343734-45343764
  Hypo

SEQ ID NO: 121404 - DNA, 30 bp, Homo sapiens; identical to SEQ ID NO: 89650
  chr22:45395822-45395852
  Hypo

SEQ ID NO: 121405 - DNA, 401 bp, Homo sapiens; identical to SEQ ID NO: 89651
  chr22:45402788-45403189
  Hyper

SEQ ID NO: 121406 - DNA, 1803 bp, Homo sapiens
  chr22:45403911-45405714
  Hyper
ttccccgggagctggcgtcaggttccaagaataaaaagtgaagctagggaagtggaaggtggtgggggggagggagcctcgaggaacgatttcaaaacgaggtttgccacggaacccagaaatcgcttccaacgagtttggtgtccaggcccccacggccgcccccctccgcccccatggccgcctcagcgcaaagcgggggactccgagccgggagaaatcgccacgttccaaaaacatgtccaccacctcaaaatggacgccgggccgcgcgctgccttttaagtgagctcctctcttcggcccccgcagggcccggctctccctgccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgggggccgaggccacccggcggcgcgccccgagccgtgcaagtttgcaggccggggtgcgtgtgcgagtgagtgtgagtgtgagtgtgtgccgggggaggggggaggaacaaagagccaagtaaacacggcgagtccgtgtcgagcaaagctcataaatattcaagtcgcgtcctaatctccccaacacacacacgcgcacgccgagccccgctcaggctccggccgccacgccgccgctcgccagcagcgatcgccaaaactacttctgcacaccgggcaggttcgcccggggcgcgggggcccgaggggaggccggaagggggcctattcgcactcccctccccgggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagcctggaagacccagagacccggaagagaggatgctgggctcgggtcccccgaccccctcaccccgcaacacactccccggccccgggcccggcccccggccacctacctggtggcgcgcgagttccacggcgagcgcctcgggccggctctgcagctccatcccggcaacttgggcagcactttgcgctcactttggcccgggctcccgggaagttgcgcggctccgcgggggccagagcgggcgcgggcggacgcggcctccgggctgggttgggggggacacgagccccctcccccacggccgaaagggaagggggctggcgaaggggaagacaggcttccgggcgccgcggcgccgagccctcggctgccccaactcctcaggctgcccggcaagttgcgccgggtccccgggctgccggcgcggcccggagcatggccccc

SEQ ID NO: 121407 - DNA, 441 bp, Homo sapiens
  chr22:45405944-45406385
  Hyper
gccccgcccccgccccgcccgcgcctgcgcactgccgccccgccgcggcccggcaccccgagcggagaacaaaagtggcggtggacggggacgcacggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatattttatttaaattcttccgtcccctcctgtccataccagcgccgcgacttgggggattaaattagtcgcgtcgccacattcccccgccgcctgatggcctccgtgttgtttaaaca

SEQ ID NO: 121408 - DNA, 142 bp, Homo sapiens; identical to SEQ ID NO: 89658
  chr22:45477440-45477582
  Hypo

SEQ ID NO: 121409 - DNA, 49 bp, Homo sapiens; identical to SEQ ID NO: 16801
  chr22:45593666-45593715
  Hypo

SEQ ID NO: 121410 - DNA, 104 bp, Homo sapiens; identical to SEQ ID NO: 89660
  chr22:45595127-45595231
  Hypo

SEQ ID NO: 121411 - DNA, 30 bp, Homo sapiens; identical to SEQ ID NO: 89661
  chr22:45603916-45603946
  Hypo

SEQ ID NO: 121412 - DNA, 203 bp, Homo sapiens; identical to SEQ ID NO: 89662
  chr22:45604184-45604387
  Hypo

SEQ ID NO: 121413 - DNA, 218 bp, Homo sapiens; identical to SEQ ID NO: 89663
  chr22:45680590-45680808
  Hyper

SEQ ID NO: 121414 - DNA, 142 bp, Homo sapiens; identical to SEQ ID NO: 89664
  chr22:45809468-45809610
  Hyper

SEQ ID NO: 121415 - DNA, 722 bp, Homo sapiens
  chr22:45898351-45899073
  Hyper
agggtgcggggttggcggtaaggcctgccccagtgccccccagcagccgggcctccgactgcaggcccgggtccccgctcctccgcgcggagtcgggcggggataacctttgatcccgagccctcccctcgagagggggtggggggaggaggggatcgggtttcacggagtgttgggggataggactgggggcatccggcccgaaggcgccccctctgtgccccctccggggaagtctgggatccaggccctcgcccccagccgtgggcgcgcgcccctcgcagccggggtccggggagggagggtcccggcagggggcgccggggagggaggaccaggagacccgcggccccgcctccgccgcgccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggaggtaggggcgtcccgggtccgccgccccagcttagggtcccgaccccctcggcctcgcgctccctgcgagtttcggaaccacggggactcggagtccgtgcgttgccctgcgcggcgcccccggactgtc

SEQ ID NO: 121416 - DNA, 106 bp, Homo sapiens; identical to SEQ ID NO: 46773
  chr22:45931289-45931395
  Hypo

SEQ ID NO: 121417 - DNA, 55 bp, Homo sapiens; identical to SEQ ID NO: 89668
  chr22:45939677-45939732
  Hypo

SEQ ID NO: 121418 - DNA, 30 bp, Homo sapiens; identical to SEQ ID NO: 46774
  chr22:45981309-45981339
  Hypo

SEQ ID NO: 121419 - DNA, 30 bp, Homo sapiens; identical to SEQ ID NO: 89670
  chr22:46077505-46077535
  Hypo

SEQ ID NO: 121420 - DNA, 1430 bp, Homo sapiens
  chr22:46262418-46263848
  Hyper
gggaggtggagacagcgcgctcccgagccctggaccactccctctgccccgcgcggggccgagctccacggcacgtgctttggcttggaccgggaaggcccgcagtcccacagtgcccggggaggacggtccgcgccttccacgacttcgcgccgcccgcgtggctgcagcgccgtggcccggggacgcgaggccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaaggcgagaacagcagctccgcgccgcccctggtgctggagaaccgctggggcctcgggagagggcgcggcgcggcggagcggccctggcagccggagggcgcgtgtggccagggccgatcctgcactgccctctgcgggatggcccggcccagtcctcgacccccagcacctccgccgcccggcctggccaccacctccgctccacgcgcccaggccgctcccgtcgcgggtctcggagattctcccgcgcccaggggtgtcccgcagccccgggcctcagcacccagcgctcccttctccacgacgacaatgaggcggaccctccccagcgccctccagagctgtcgcatcccgggaggtcagggcgagtgttgtttgcatttcacagagcaggaagcttaggcacagacagcggctccccgaccctcgctcggcctctgctgagcagggaacggcctgaacgcgtccggccaagcgccgcctccggcctctgcccgcggcccggcgcgccctcctccccagcgcgcccctatcctgcacgcatccgcggccccgggccctttccgcagccccacgcggtctcctcccgggttaaatctatccactcgcgcgttccttggcagccgtgatcacaggcgtgaccacggtccccaagccctcgcgcctccgtccacgctattgcggccgcccctgcgcgcctgtcccctccctgtcccctccttccagctctggaaacagcagcaccggaagccccctgccccagactcactgcccacccccggccgagctggctgccag

SEQ ID NO: 121421 - DNA, 130 bp, Homo sapiens; identical to SEQ ID NO: 89674
  chr22:46276993-46277123
  Hyper

SEQ ID NO: 121422 - DNA, 30 bp, Homo sapiens; identical to SEQ ID NO: 89675
  chr22:46278524-46278554
  Hypo

SEQ ID NO: 121423 - DNA, 39 bp, Homo sapiens; identical to SEQ ID NO: 89676
  chr22:46318740-46318779
  Hypo

SEQ ID NO: 121424 - DNA, 30 bp, Homo sapiens; identical to SEQ ID NO: 89677
  chr22:46346365-46346395
  Hypo

SEQ ID NO: 121425 - DNA, 58 bp, Homo sapiens; identical to SEQ ID NO: 38600
  chr22:46367066-46367124
  Hyper

SEQ ID NO: 121426 - DNA, 303 bp, Homo sapiens
  chr22:46368029-46368332
  Hyper
ctcacaagtagctgccgctggacaggaggagaaagatctgcgggcaatagacggagacgagcgcgctgcgcggcgacagtagaagcatggtgggccggcgtgcctggcggggctgaacaggctccgcgggccgggcgcctgggccagctgaggccggggtccccgcggagctccccgatgcagggcggcggcgctgggcgctaggggccgggtctcgtgggcccgggcgcagttgtcgcccgtgccccgccgctagggccgcgcatggcgctgggtctggggcagcggcgggagctggggctg

SEQ ID NO: 121427 - DNA, 404 bp, Homo sapiens; identical to SEQ ID NO: 89680
  chr22:46372053-46372457
  Hyper

SEQ ID NO: 121428 - DNA, 30 bp, Homo sapiens; identical to SEQ ID NO: 89681
  chr22:46372944-46372974
  Hyper

SEQ ID NO: 121429 - DNA, 47 bp, Homo sapiens; identical to SEQ ID NO: 89682
  chr22:46373779-46373826
  Hyper

SEQ ID NO: 121430 - DNA, 24 bp, Homo sapiens
  chr22:46410610-46410634
  Hypo
gtgagccaccgcgcacggctatcc

SEQ ID NO: 121431 - DNA, 172 bp, Homo sapiens; identical to SEQ ID NO: 89684
  chr22:46435835-46436007
  Hypo

SEQ ID NO: 121432 - DNA, 27 bp, Homo sapiens
  chr22:46438085-46438112
  Hypo
aaaatcagctgggcacgttggctcacg

SEQ ID NO: 121433 - DNA, 153 bp, Homo sapiens; identical to SEQ ID NO: 89686
  chr22:46440550-46440703
  Hyper

SEQ ID NO: 121434 - DNA, 120 bp, Homo sapiens
  chr22:46440994-46441114
  Hyper
gccgctgcaccggagcgcacggccgagcccgcggcccggcccccggcgaagtcagcccccagcctcccaaacaaagactcgcaaagttcggaagagaatctttcccgacattttccctcc

SEQ ID NO: 121435 - DNA, 118 bp, Homo sapiens; identical to SEQ ID NO: 89688
  chr22:46495143-46495261
  Hypo

SEQ ID NO: 121436 - DNA, 30 bp, Homo sapiens; identical to SEQ ID NO: 89689
  chr22:46498655-46498685
  Hypo

SEQ ID NO: 121437 - DNA, 55 bp, Homo sapiens; identical to SEQ ID NO: 89690
  chr22:46512624-46512679
  Hyper

SEQ ID NO: 121438 - DNA, 187 bp, Homo sapiens; identical to SEQ ID NO: 89691
  chr22:46521852-46522039
  Hypo

SEQ ID NO: 121439 - DNA, 53 bp, Homo sapiens; identical to SEQ ID NO: 89692
  chr22:46545478-46545531
  Hyper

SEQ ID NO: 121440 - DNA, 30 bp, Homo sapiens; identical to SEQ ID NO: 89693
  chr22:46571644-46571674
  Hypo

SEQ ID NO: 121441 - DNA, 34 bp, Homo sapiens; identical to SEQ ID NO: 89694
  chr22:46615432-46615466
  Hypo

SEQ ID NO: 121442 - DNA, 232 bp, Homo sapiens; identical to SEQ ID NO: 89695
  chr22:46634500-46634732
  Hypo

SEQ ID NO: 121443 - DNA, 21 bp, Homo sapiens
  chr22:46651216-46651237
  Hypo
ccactgcgcccagcccccatg

SEQ ID NO: 121444 - DNA, 286 bp, Homo sapiens
  chr22:46658633-46658919
  Hyper
cggcctgcaacatcacgcgcgcggggccgtctgtggggcactcggtgcgggccacgaagccctgctggggccgcgggcctggcgcggcggagcgcggggagacgcgggccgcgggggaggccgggcgggcggcgccgggtccgagcagccgcaggcggaaggcccaggccaggcgcccgggcgagcgcggcagccgcacggaccacgtcagggagaggcggccgccgcgcgcggagagctgcaggtcgacgagcgcgagcgcgggcgcggccggccagggcaggcg

SEQ ID NO: 121445 - DNA, 144 bp, Homo sapiens; identical to SEQ ID NO: 89698
  chr22:46719046-46719190
  Hypo

SEQ ID NO: 121446 - DNA, 37 bp, Homo sapiens; identical to SEQ ID NO: 89699
  chr22:46748950-46748987
  Hypo

SEQ ID NO: 121447 - DNA, 77 bp, Homo sapiens; identical to SEQ ID NO: 89700
  chr22:46770807-46770884
  Hypo

SEQ ID NO: 121448 - DNA, 138 bp, Homo sapiens; identical to SEQ ID NO: 89701
  chr22:46805005-46805143
  Hypo

SEQ ID NO: 121449 - DNA, 30 bp, Homo sapiens; identical to SEQ ID NO: 89702
  chr22:46847001-46847031
  Hypo

SEQ ID NO: 121450 - DNA, 148 bp, Homo sapiens; identical to SEQ ID NO: 46779
  chr22:46929253-46929401
  Hypo

SEQ ID NO: 121451 - DNA, 93 bp, Homo sapiens; identical to SEQ ID NO: 89704
  chr22:46929625-46929718
  Hypo

SEQ ID NO: 121452 - DNA, 113 bp, Homo sapiens; identical to SEQ ID NO: 89705
  chr22:46929921-46930034
  Hypo

SEQ ID NO: 121453 - DNA, 30 bp, Homo sapiens; identical to SEQ ID NO: 89706
  chr22:46930811-46930841
  Hypo

SEQ ID NO: 121454 - DNA, 30 bp, Homo sapiens; identical to SEQ ID NO: 89707
  chr22:46931231-46931261
  Hypo

SEQ ID NO: 121455 - DNA, 409 bp, Homo sapiens; identical to SEQ ID NO: 89708
  chr22:46931719-46932128
  Hypo

SEQ ID NO: 121456 - DNA, 277 bp, Homo sapiens; identical to SEQ ID NO: 89709
  chr22:46932725-46933002
  Hyper

SEQ ID NO: 121457 - DNA, 173 bp, Homo sapiens; identical to SEQ ID NO: 46782
  chr22:47005073-47005246
  Hypo

SEQ ID NO: 121458 - DNA, 57 bp, Homo sapiens; identical to SEQ ID NO: 46783
  chr22:47005505-47005562
  Hypo

SEQ ID NO: 121459 - DNA, 81 bp, Homo sapiens; identical to SEQ ID NO: 89712
  chr22:47022551-47022632
  Hypo

SEQ ID NO: 121460 - DNA, 69 bp, Homo sapiens; identical to SEQ ID NO: 89713
  chr22:47023112-47023181
  Hypo

SEQ ID NO: 121461 - DNA, 89 bp, Homo sapiens; identical to SEQ ID NO: 89714
  chr22:47054535-47054624
  Hypo

SEQ ID NO: 121462 - DNA, 36 bp, Homo sapiens; identical to SEQ ID NO: 46785
  chr22:47193335-47193371
  Hypo

SEQ ID NO: 121463 - DNA, 30 bp, Homo sapiens; identical to SEQ ID NO: 89716
  chr22:47298494-47298524
  Hypo

SEQ ID NO: 121464 - DNA, 30 bp, Homo sapiens; identical to SEQ ID NO: 89717
  chr22:47328152-47328182
  Hypo

SEQ ID NO: 121465 - DNA, 183 bp, Homo sapiens; identical to SEQ ID NO: 89718
  chr22:47428866-47429049
  Hypo

SEQ ID NO: 121466 - DNA, 78 bp, Homo sapiens; identical to SEQ ID NO: 89719
  chr22:47523374-47523452
  Hypo

SEQ ID NO: 121467 - DNA, 219 bp, Homo sapiens; identical to SEQ ID NO: 46787
  chr22:47525705-47525924
  Hypo

SEQ ID NO: 121468 - DNA, 66 bp, Homo sapiens; identical to SEQ ID NO: 89721
  chr22:47594807-47594873
  Hypo

SEQ ID NO: 121469 - DNA, 143 bp, Homo sapiens; identical to SEQ ID NO: 89722
  chr22:47598585-47598728
  Hypo

SEQ ID NO: 121470 - DNA, 158 bp, Homo sapiens; identical to SEQ ID NO: 89723
  chr22:47605408-47605566
  Hypo

SEQ ID NO: 121471 - DNA, 16 bp, Homo sapiens
  chr22:47622148-47622164
  Hypo
gcggtttggatggctg

SEQ ID NO: 121472 - DNA, 39 bp, Homo sapiens; identical to SEQ ID NO: 89725
  chr22:47666772-47666811
  Hypo

SEQ ID NO: 121473 - DNA, 100 bp, Homo sapiens; identical to SEQ ID NO: 89726
  chr22:47739194-47739294
  Hypo

SEQ ID NO: 121474 - DNA, 36 bp, Homo sapiens; identical to SEQ ID NO: 89727
  chr22:47840461-47840497
  Hypo

SEQ ID NO: 121475 - DNA, 110 bp, Homo sapiens; identical to SEQ ID NO: 89728
  chr22:48027676-48027786
  Hypo

SEQ ID NO: 121476 - DNA, 30 bp, Homo sapiens; identical to SEQ ID NO: 89729
  chr22:48465028-48465058
  Hypo

SEQ ID NO: 121477 - DNA, 173 bp, Homo sapiens; identical to SEQ ID NO: 89730
  chr22:48548955-48549128
  Hypo

SEQ ID NO: 121478 - DNA, 34 bp, Homo sapiens; identical to SEQ ID NO: 46790
  chr22:48553477-48553511
  Hypo

SEQ ID NO: 121479 - DNA, 30 bp, Homo sapiens; identical to SEQ ID NO: 89732
  chr22:48631792-48631822
  Hypo

SEQ ID NO: 121480 - DNA, 30 bp, Homo sapiens; identical to SEQ ID NO: 89733
  chr22:48657078-48657108
  Hypo

SEQ ID NO: 121481 - DNA, 67 bp, Homo sapiens; identical to SEQ ID NO: 89734
  chr22:48661092-48661159
  Hypo

SEQ ID NO: 121482 - DNA, 86 bp, Homo sapiens; identical to SEQ ID NO: 89735
  chr22:48728717-48728803
  Hypo

SEQ ID NO: 121483 - DNA, 30 bp, Homo sapiens; identical to SEQ ID NO: 89736
  chr22:48729299-48729329
  Hypo

SEQ ID NO: 121484 - DNA, 30 bp, Homo sapiens; identical to SEQ ID NO: 46793
  chr22:48793754-48793784
  Hypo

SEQ ID NO: 121485 - DNA, 30 bp, Homo sapiens; identical to SEQ ID NO: 89738
  chr22:48836877-48836907
  Hypo

SEQ ID NO: 121486 - DNA, 2071 bp, Homo sapiens
  chr22:48884914-48886985
  Hyper
tccaggccctggctgcggtggatgggggcgcggaaggcccaagtgcgcgaacttcacctggcccggccgtcctccccgtggggggcccaggctgcgggcgcgtcaggccgtctctgtcgccatccggaggagcggcttgggcgccgcgtcccctctgccaggcccgggtcggcgggcggctggagcccccagcggtggcgggcgcgcgcctctctcgcggatgccggggcgcgcgtagccggggcgcgcagtgacgcccagagcggggccggcgtccccctggcgggccggcgcggggtcggcgggcgcgggcgcgagcgcgggcggcgcgggcgcggcgcggggcgcggtgggccggggcccgggcgcggcggcggcggcggcggaggatggcgcgcgcggggcccgcacgtggaggccggcgcgggggcgcgggcagggccggctgctgagacgcgctgctgccccccgcgcgggcgccgcggcttcaatggcgccatcgcccaggaccggcagccggcaagatgcgaccgccctgcccagcatgtcctcaactttctgggcgttcatgatcctggccagcctgctcatcgcctactgcagtgagtaccgcgcggccccggccccggcacggccctctgggccccggaccccctcctccggccccggcaggcgccccgcgggcctcccggagtcggcgcggagttacgagcgccgggcgcatggtcccccgagtcccggccggtccaacgctgcgctgggcgggcgagagggtccacccgggttccgggcgctcgagcacttcggggtcggacgccccggcccgagcctcccttccctgactccccggcagggcccgggctccaggccccgggtggcgcggcccgtccctgcccggcggtcggagcccagccagcggcttcccggccgagatgcgcgctcaggaggcagccgcaggtcgcggagggcgggcggcgctgccggggtgtctgcggagcgccctccccgtgcctcagcccgggacaaggggggaggcggcggccgagcccggagaggagctcttcaggcaggagcccagcctgggctcggaggagcagctggagcttccgctttcccgggaaacgggctcgtcaggcgccttctggaaagagaagcgaagtgagggatgggatgcccggagggggctcgccgcggccgcggacgtttctcgggtcgtgtctggggcccgagctggtgaccggcgggactggcgcgggcgcgggctggggtggtgcgggccagtgggcgcccgggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtgggtgcgccggcgcccctgggaactcactggctggccgcctgcagggagca

SEQ ID NO: 121487 - DNA, 175 bp, Homo sapiens; identical to SEQ ID NO: 89743
  chr22:48907729-48907904
  Hypo

SEQ ID NO: 121488 - DNA, 98 bp, Homo sapiens; identical to SEQ ID NO: 89744
  chr22:48912088-48912186
  Hypo

SEQ ID NO: 121489 - DNA, 198 bp, Homo sapiens; identical to SEQ ID NO: 89745
  chr22:48917385-48917583
  Hypo

SEQ ID NO: 121490 - DNA, 37 bp, Homo sapiens; identical to SEQ ID NO: 89746
  chr22:48919191-48919228
  Hypo

SEQ ID NO: 121491 - DNA, 241 bp, Homo sapiens; identical to SEQ ID NO: 46795
  chr22:48931827-48932068
  Hypo

SEQ ID NO: 121492 - DNA, 40 bp, Homo sapiens; identical to SEQ ID NO: 89748
  chr22:48939361-48939401
  Hypo

SEQ ID NO: 121493 - DNA, 30 bp, Homo sapiens; identical to SEQ ID NO: 89749
  chr22:48947525-48947555
  Hypo

SEQ ID NO: 121494 - DNA, 94 bp, Homo sapiens; identical to SEQ ID NO: 89750
  chr22:48958660-48958754
  Hypo

SEQ ID NO: 121495 - DNA, 1907 bp, Homo sapiens
  chr22:48970842-48972749
  Hyper
tccaggcagatgtgccgttttcagaagccgcgggaccagcctcctccgagccctcccagccgctggtcgggcccggctggggcggtacctgggcctggggtttccctgtctctcctggggccttgggtgcgagggaggctgggcgccactcgaggccccgcgtccggtctcccgcgccagcagggccggctctgcagtgaggcccctgcgcacctaggtggagcccgacccgcagttttcggctgggccggccccacctgacccgccggcgcgccaggcgggggcgctgcagggcggggtccccggggtccctcgcggcccagtgcgcatccgcggctccgcggccgggaggagcgcagacggcggcgggcgcgggccggagtccgaggctgcgcgggcccggccacctgggccggcagcgactgcgccgcgctccccctcccgccgcctcccccgaggagccggcgccgagccgagcgggcgggcgcgcgcctccaggccggagcagcggcgtcccgcgggcggcgaggcgcgcagcgtcgccggccccacctgtaggcgcggcagccaccggcaccggcaccgacaccggcagcggcggcccagcgtgggcagcccaggggcgcggtgggcccggacctagtcccggccgcggcggcggaggcgcgggctgctgggagcgcagaggccggcaccgtccggtggggaccggcccgccagccccgggccgcgcaagttcgatcgccgcgggctcggccgggccgcgcggaccccggcggcggcgatggtgcggcagccccgcgcccggcgcgcagccccggccccgagcctggcccgccgcggcggcggtggcggcggcggcgcggcggccccctgagccccgggccggagcgagcgcgggcggcggaggaggcggcggcggcggaggaagaggaggaggaggaaggcgacgccgagcagcgggcggtgggggccgacaggcggaggagggggccggggccgcgccggaccccccccccccccgcgccgcccggccgttgcgcaatccgcggcccgccgtccgggccctgctggcggtgcggctccgggggcggcggcggggctgattcatggggccgcggcggccgccccccggcgccccgcagccagcgatggtggccgagtggtcggagcggcggccgccgcggcccgagactttctgctaacctccccgcccccgcccgccccctccgcggcgcccccctccccccgcccgctcccctcccccctgcccagaaagacacaaatcgcctcccggagtggcgcctccagtcgcggcggagcgcggcgttggcggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtaattgtccccgggcgcgcggaccggtcctccgcgctctgcccggctcgcggcggctccggcgcccgacccggcttccagcacgttccgctgccgccgcgctcggctgaggctcgtggagcgccactgcgggcccggagcggccggcggcgcgaccctaccaggagcccgaccccccgcggatctcgctgccccgcgcccatcggggctcaccggcagggcgcggggtcggggcgcgctgcgttctcggtgcctctggcgccgccccggatccccagcccaagccgaggctgccgttcccatcccctgccccactgggctcggtggcagcggcgcccgcccgcacgccgccgggccctcggtaga

SEQ ID NO: 121496 - DNA, 106 bp, Homo sapiens; identical to SEQ ID NO: 46796
  chr22:48976157-48976263
  Hypo

SEQ ID NO: 121497 - DNA, 144 bp, Homo sapiens; identical to SEQ ID NO: 46797
  chr22:48987212-48987356
  Hypo

SEQ ID NO: 121498 - DNA, 72 bp, Homo sapiens; identical to SEQ ID NO: 89758
  chr22:48996677-48996749
  Hypo

SEQ ID NO: 121499 - DNA, 30 bp, Homo sapiens; identical to SEQ ID NO: 89759
  chr22:48997695-48997725
  Hypo

SEQ ID NO: 121500 - DNA, 152 bp, Homo sapiens; identical to SEQ ID NO: 89760
  chr22:49013333-49013485
  Hypo

SEQ ID NO: 121501 - DNA, 30 bp, Homo sapiens; identical to SEQ ID NO: 89761
  chr22:49039051-49039081
  Hypo

SEQ ID NO: 121502 - DNA, 186 bp, Homo sapiens; identical to SEQ ID NO: 89762
  chr22:49048024-49048210
  Hypo

SEQ ID NO: 121503 - DNA, 52 bp, Homo sapiens; identical to SEQ ID NO: 89763
  chr22:49063305-49063357
  Hypo

SEQ ID NO: 121504 - DNA, 30 bp, Homo sapiens; identical to SEQ ID NO: 89764
  chr22:49070079-49070109
  Hypo

SEQ ID NO: 121505 - DNA, 194 bp, Homo sapiens; identical to SEQ ID NO: 89765
  chr22:49115630-49115824
  Hypo

SEQ ID NO: 121506 - DNA, 84 bp, Homo sapiens; identical to SEQ ID NO: 89766
  chr22:49117075-49117159
  Hypo

SEQ ID NO: 121507 - DNA, 146 bp, Homo sapiens; identical to SEQ ID NO: 89767
  chr22:49132497-49132643
  Hypo

SEQ ID NO: 121508 - DNA, 30 bp, Homo sapiens; identical to SEQ ID NO: 46801
  chr22:49138471-49138501
  Hypo

SEQ ID NO: 121509 - DNA, 30 bp, Homo sapiens; identical to SEQ ID NO: 89769
  chr22:49139651-49139681
  Hypo

SEQ ID NO: 121510 - DNA, 210 bp, Homo sapiens; identical to SEQ ID NO: 89770
  chr22:49145839-49146049
  Hypo

SEQ ID NO: 121511 - DNA, 243 bp, Homo sapiens; identical to SEQ ID NO: 89771
  chr22:49147007-49147250
  Hypo

SEQ ID NO: 121512 - DNA, 73 bp, Homo sapiens; identical to SEQ ID NO: 89772
  chr22:49149757-49149830
  Hypo

SEQ ID NO: 121513 - DNA, 30 bp, Homo sapiens; identical to SEQ ID NO: 89773
  chr22:49153919-49153949
  Hypo

SEQ ID NO: 121514 - DNA, 16 bp, Homo sapiens
  chr22:49170462-49170478
  Hypo
gcgtttttatagagct

SEQ ID NO: 121515 - DNA, 30 bp, Homo sapiens; identical to SEQ ID NO: 89775
  chr22:49175177-49175207
  Hypo

SEQ ID NO: 121516 - DNA, 30 bp, Homo sapiens; identical to SEQ ID NO: 89776
  chr22:49177385-49177415
  Hypo

SEQ ID NO: 121517 - DNA, 30 bp, Homo sapiens; identical to SEQ ID NO: 89777
  chr22:49195092-49195122
  Hypo

SEQ ID NO: 121518 - DNA, 63 bp, Homo sapiens; identical to SEQ ID NO: 89778
  chr22:49198381-49198444
  Hypo

SEQ ID NO: 121519 - DNA, 30 bp, Homo sapiens; identical to SEQ ID NO: 89779
  chr22:49233404-49233434
  Hypo

SEQ ID NO: 121520 - DNA, 102 bp, Homo sapiens; identical to SEQ ID NO: 89780
  chr22:49247239-49247341
  Hypo

SEQ ID NO: 121521 - DNA, 30 bp, Homo sapiens; identical to SEQ ID NO: 89781
  chr22:49257599-49257629
  Hypo

SEQ ID NO: 121522 - DNA, 78 bp, Homo sapiens; identical to SEQ ID NO: 89782
  chr22:49277436-49277514
  Hypo

SEQ ID NO: 121523 - DNA, 30 bp, Homo sapiens; identical to SEQ ID NO: 89783
  chr22:49282479-49282509
  Hypo

SEQ ID NO: 121524 - DNA, 30 bp, Homo sapiens; identical to SEQ ID NO: 89784
  chr22:49295585-49295615
  Hypo

SEQ ID NO: 121525 - DNA, 30 bp, Homo sapiens; identical to SEQ ID NO: 89785
  chr22:49297953-49297983
  Hypo

SEQ ID NO: 121526 - DNA, 52 bp, Homo sapiens; identical to SEQ ID NO: 89786
  chr22:49340964-49341016
  Hypo

SEQ ID NO: 121527 - DNA, 87 bp, Homo sapiens; identical to SEQ ID NO: 89787
  chr22:49387604-49387691
  Hypo

SEQ ID NO: 121528 - DNA, 150 bp, Homo sapiens; identical to SEQ ID NO: 89788
  chr22:49388460-49388610
  Hypo

SEQ ID NO: 121529 - DNA, 155 bp, Homo sapiens; identical to SEQ ID NO: 89789
  chr22:49404122-49404277
  Hypo

SEQ ID NO: 121530 - DNA, 191 bp, Homo sapiens; identical to SEQ ID NO: 89790
  chr22:49416905-49417096
  Hypo

SEQ ID NO: 121531 - DNA, 84 bp, Homo sapiens; identical to SEQ ID NO: 89791
  chr22:49447288-49447372
  Hypo

SEQ ID NO: 121532 - DNA, 98 bp, Homo sapiens; identical to SEQ ID NO: 89792
  chr22:49491699-49491797
  Hypo

SEQ ID NO: 121533 - DNA, 134 bp, Homo sapiens; identical to SEQ ID NO: 89793
  chr22:49508009-49508143
  Hypo

SEQ ID NO: 121534 - DNA, 30 bp, Homo sapiens; identical to SEQ ID NO: 46810
  chr22:49510169-49510199
  Hypo

SEQ ID NO: 121535 - DNA, 36 bp, Homo sapiens; identical to SEQ ID NO: 89795
  chr22:49524652-49524688
  Hypo

SEQ ID NO: 121536 - DNA, 30 bp, Homo sapiens; identical to SEQ ID NO: 89796
  chr22:49557840-49557870
  Hypo

SEQ ID NO: 121537 - DNA, 30 bp, Homo sapiens; identical to SEQ ID NO: 89797
  chr22:49578631-49578661
  Hypo

SEQ ID NO: 121538 - DNA, 30 bp, Homo sapiens; identical to SEQ ID NO: 89798
  chr22:49584808-49584838
  Hypo

SEQ ID NO: 121539 - DNA, 30 bp, Homo sapiens; identical to SEQ ID NO: 89799
  chr22:49632704-49632734
  Hypo

SEQ ID NO: 121540 - DNA, 253 bp, Homo sapiens; identical to SEQ ID NO: 46811
  chr22:49637528-49637781
  Hypo

SEQ ID NO: 121541 - DNA, 39 bp, Homo sapiens; identical to SEQ ID NO: 89801
  chr22:49683091-49683130
  Hypo

SEQ ID NO: 121542 - DNA, 203 bp, Homo sapiens; identical to SEQ ID NO: 89802
  chr22:49691277-49691480
  Hypo

SEQ ID NO: 121543 - DNA, 153 bp, Homo sapiens; identical to SEQ ID NO: 89803
  chr22:49694454-49694607
  Hypo

SEQ ID NO: 121544 - DNA, 182 bp, Homo sapiens; identical to SEQ ID NO: 89804
  chr22:49694859-49695041
  Hypo

SEQ ID NO: 121545 - DNA, 30 bp, Homo sapiens; identical to SEQ ID NO: 89805
  chr22:49704081-49704111
  Hypo

SEQ ID NO: 121546 - DNA, 37 bp, Homo sapiens; identical to SEQ ID NO: 89806
  chr22:49722594-49722631
  Hypo

SEQ ID NO: 121547 - DNA, 30 bp, Homo sapiens; identical to SEQ ID NO: 89807
  chr22:49729017-49729047
  Hypo

SEQ ID NO: 121548 - DNA, 30 bp, Homo sapiens; identical to SEQ ID NO: 89808
  chr22:49745207-49745237
  Hypo

SEQ ID NO: 121549 - DNA, 32 bp, Homo sapiens; identical to SEQ ID NO: 89809
  chr22:49748891-49748923
  Hypo

SEQ ID NO: 121550 - DNA, 57 bp, Homo sapiens; identical to SEQ ID NO: 89810
  chr22:49785322-49785379
  Hypo

SEQ ID NO: 121551 - DNA, 115 bp, Homo sapiens; identical to SEQ ID NO: 89811
  chr22:49814611-49814726
  Hypo

SEQ ID NO: 121552 - DNA, 30 bp, Homo sapiens; identical to SEQ ID NO: 89812
  chr22:49827331-49827361
  Hypo

SEQ ID NO: 121553 - DNA, 87 bp, Homo sapiens; identical to SEQ ID NO: 89813
  chr22:49828938-49829025
  Hypo

SEQ ID NO: 121554 - DNA, 122 bp, Homo sapiens; identical to SEQ ID NO: 89814
  chr22:49831405-49831527
  Hypo

SEQ ID NO: 121555 - DNA, 138 bp, Homo sapiens; identical to SEQ ID NO: 89815
  chr22:49831849-49831987
  Hypo

SEQ ID NO: 121556 - DNA, 30 bp, Homo sapiens; identical to SEQ ID NO: 89816
  chr22:49832454-49832484
  Hypo

SEQ ID NO: 121557 - DNA, 30 bp, Homo sapiens; identical to SEQ ID NO: 89817
  chr22:49833286-49833316
  Hypo

SEQ ID NO: 121558 - DNA, 96 bp, Homo sapiens; identical to SEQ ID NO: 89818
  chr22:49836808-49836904
  Hypo

SEQ ID NO: 121559 - DNA, 30 bp, Homo sapiens; identical to SEQ ID NO: 89819
  chr22:49849362-49849392
  Hypo

SEQ ID NO: 121560 - DNA, 180 bp, Homo sapiens; identical to SEQ ID NO: 89820
  chr22:49851733-49851913
  Hypo

SEQ ID NO: 121561 - DNA, 274 bp, Homo sapiens; identical to SEQ ID NO: 89821
  chr22:49852443-49852717
  Hypo

SEQ ID NO: 121562 - DNA, 30 bp, Homo sapiens; identical to SEQ ID NO: 89822
  chr22:49863553-49863583
  Hypo

SEQ ID NO: 121563 - DNA, 57 bp, Homo sapiens; identical to SEQ ID NO: 89823
  chr22:49864413-49864470
  Hypo

SEQ ID NO: 121564 - DNA, 149 bp, Homo sapiens; identical to SEQ ID NO: 46819
  chr22:49864707-49864856
  Hypo

SEQ ID NO: 121565 - DNA, 112 bp, Homo sapiens; identical to SEQ ID NO: 89825
  chr22:49868073-49868185
  Hypo

SEQ ID NO: 121566 - DNA, 39 bp, Homo sapiens; identical to SEQ ID NO: 46821
  chr22:49888284-49888323
  Hypo

SEQ ID NO: 121567 - DNA, 80 bp, Homo sapiens; identical to SEQ ID NO: 89827
  chr22:49911506-49911586
  Hypo

SEQ ID NO: 121568 - DNA, 667 bp, Homo sapiens; identical to SEQ ID NO: 89828
  chr22:49934713-49935380
  Hypo

SEQ ID NO: 121569 - DNA, 184 bp, Homo sapiens; identical to SEQ ID NO: 89829
  chr22:49937697-49937881
  Hypo

SEQ ID NO: 121570 - DNA, 69 bp, Homo sapiens; identical to SEQ ID NO: 89830
  chr22:49941794-49941863
  Hypo

SEQ ID NO: 121571 - DNA, 196 bp, Homo sapiens; identical to SEQ ID NO: 89831
  chr22:49943168-49943364
  Hypo

SEQ ID NO: 121572 - DNA, 42 bp, Homo sapiens; identical to SEQ ID NO: 89832
  chr22:49948578-49948620
  Hypo

SEQ ID NO: 121573 - DNA, 109 bp, Homo sapiens; identical to SEQ ID NO: 89833
  chr22:49959096-49959205
  Hypo

SEQ ID NO: 121574 - DNA, 130 bp, Homo sapiens; identical to SEQ ID NO: 89834
  chr22:49963301-49963431
  Hypo

SEQ ID NO: 121575 - DNA, 43 bp, Homo sapiens; identical to SEQ ID NO: 89835
  chr22:49963875-49963918
  Hypo

SEQ ID NO: 121576 - DNA, 198 bp, Homo sapiens; identical to SEQ ID NO: 89836
  chr22:49967979-49968177
  Hypo

SEQ ID NO: 121577 - DNA, 145 bp, Homo sapiens; identical to SEQ ID NO: 89837
  chr22:49970518-49970663
  Hypo

SEQ ID NO: 121578 - DNA, 189 bp, Homo sapiens; identical to SEQ ID NO: 89838
  chr22:49977647-49977836
  Hypo

SEQ ID NO: 121579 - DNA, 144 bp, Homo sapiens; identical to SEQ ID NO: 89839
  chr22:49979613-49979757
  Hypo

SEQ ID NO: 121580 - DNA, 461 bp, Homo sapiens; identical to SEQ ID NO: 89840
  chr22:49980160-49980621
  Hypo

SEQ ID NO: 121581 - DNA, 123 bp, Homo sapiens; identical to SEQ ID NO: 89841
  chr22:49982542-49982665
  Hypo

SEQ ID NO: 121582 - DNA, 179 bp, Homo sapiens; identical to SEQ ID NO: 89842
  chr22:49982979-49983158
  Hypo

SEQ ID NO: 121583 - DNA, 205 bp, Homo sapiens; identical to SEQ ID NO: 89843
  chr22:49983668-49983873
  Hypo

SEQ ID NO: 121584 - DNA, 149 bp, Homo sapiens; identical to SEQ ID NO: 89844
  chr22:49992130-49992279
  Hypo

SEQ ID NO: 121585 - DNA, 44 bp, Homo sapiens; identical to SEQ ID NO: 89845
  chr22:49992716-49992760
  Hypo

SEQ ID NO: 121586 - DNA, 112 bp, Homo sapiens; identical to SEQ ID NO: 89846
  chr22:49994187-49994299
  Hypo

SEQ ID NO: 121587 - DNA, 30 bp, Homo sapiens; identical to SEQ ID NO: 46839
  chr22:49996899-49996929
  Hypo

SEQ ID NO: 121588 - DNA, 30 bp, Homo sapiens; identical to SEQ ID NO: 46840
  chr22:50000658-50000688
  Hypo

SEQ ID NO: 121589 - DNA, 196 bp, Homo sapiens; identical to SEQ ID NO: 89849
  chr22:50001634-50001830
  Hypo

SEQ ID NO: 121590 - DNA, 357 bp, Homo sapiens; identical to SEQ ID NO: 89850
  chr22:50002462-50002819
  Hypo

SEQ ID NO: 121591 - DNA, 225 bp, Homo sapiens; identical to SEQ ID NO: 89851
  chr22:50003057-50003282
  Hypo

SEQ ID NO: 121592 - DNA, 176 bp, Homo sapiens; identical to SEQ ID NO: 46844
  chr22:50007867-50008043
  Hypo

SEQ ID NO: 121593 - DNA, 226 bp, Homo sapiens; identical to SEQ ID NO: 89853
  chr22:50008747-50008973
  Hypo

SEQ ID NO: 121594 - DNA, 147 bp, Homo sapiens; identical to SEQ ID NO: 89854
  chr22:50009183-50009330
  Hypo

SEQ ID NO: 121595 - DNA, 44 bp, Homo sapiens; identical to SEQ ID NO: 89855
  chr22:50009619-50009663
  Hypo

SEQ ID NO: 121596 - DNA, 717 bp, Homo sapiens; identical to SEQ ID NO: 89856
  chr22:50010081-50010798
  Hypo

SEQ ID NO: 121597 - DNA, 46 bp, Homo sapiens; identical to SEQ ID NO: 46848
  chr22:50013222-50013268
  Hypo

SEQ ID NO: 121598 - DNA, 179 bp, Homo sapiens; identical to SEQ ID NO: 89858
  chr22:50015584-50015763
  Hypo

SEQ ID NO: 121599 - DNA, 176 bp, Homo sapiens; identical to SEQ ID NO: 89859
  chr22:50015975-50016151
  Hypo

SEQ ID NO: 121600 - DNA, 173 bp, Homo sapiens; identical to SEQ ID NO: 89860
  chr22:50023940-50024113
  Hypo

SEQ ID NO: 121601 - DNA, 30 bp, Homo sapiens; identical to SEQ ID NO: 46851
  chr22:50025118-50025148
  Hypo

SEQ ID NO: 121602 - DNA, 177 bp, Homo sapiens; identical to SEQ ID NO: 89862
  chr22:50025502-50025679
  Hypo

SEQ ID NO: 121603 - DNA, 37 bp, Homo sapiens; identical to SEQ ID NO: 89863
  chr22:50030437-50030474
  Hypo

SEQ ID NO: 121604 - DNA, 130 bp, Homo sapiens; identical to SEQ ID NO: 89864
  chr22:50031124-50031254
  Hypo

SEQ ID NO: 121605 - DNA, 213 bp, Homo sapiens; identical to SEQ ID NO: 89865
  chr22:50031666-50031879
  Hypo

SEQ ID NO: 121606 - DNA, 198 bp, Homo sapiens; identical to SEQ ID NO: 89866
  chr22:50032291-50032489
  Hypo

SEQ ID NO: 121607 - DNA, 52 bp, Homo sapiens; identical to SEQ ID NO: 89867
  chr22:50039630-50039682
  Hypo

SEQ ID NO: 121608 - DNA, 35 bp, Homo sapiens; identical to SEQ ID NO: 89868
  chr22:50041968-50042003
  Hypo

SEQ ID NO: 121609 - DNA, 248 bp, Homo sapiens; identical to SEQ ID NO: 89869
  chr22:50054387-50054635
  Hypo

SEQ ID NO: 121610 - DNA, 201 bp, Homo sapiens; identical to SEQ ID NO: 89870
  chr22:50056957-50057158
  Hypo

SEQ ID NO: 121611 - DNA, 30 bp, Homo sapiens; identical to SEQ ID NO: 89871
  chr22:50075250-50075280
  Hypo

SEQ ID NO: 121612 - DNA, 30 bp, Homo sapiens; identical to SEQ ID NO: 89872
  chr22:50084890-50084920
  Hypo

SEQ ID NO: 121613 - DNA, 60 bp, Homo sapiens; identical to SEQ ID NO: 46858
  chr22:50119416-50119476
  Hypo

SEQ ID NO: 121614 - DNA, 46 bp, Homo sapiens; identical to SEQ ID NO: 89874
  chr22:50147751-50147797
  Hypo

SEQ ID NO: 121615 - DNA, 204 bp, Homo sapiens; identical to SEQ ID NO: 89875
  chr22:50149266-50149470
  Hypo

SEQ ID NO: 121616 - DNA, 207 bp, Homo sapiens; identical to SEQ ID NO: 89876
  chr22:50170583-50170790
  Hypo

SEQ ID NO: 121617 - DNA, 51 bp, Homo sapiens; identical to SEQ ID NO: 89877
  chr22:50177248-50177299
  Hypo

SEQ ID NO: 121618 - DNA, 45 bp, Homo sapiens; identical to SEQ ID NO: 89878
  chr22:50191581-50191626
  Hypo

SEQ ID NO: 121619 - DNA, 86 bp, Homo sapiens; identical to SEQ ID NO: 89879
  chr22:50225678-50225764
  Hypo

SEQ ID NO: 121620 - DNA, 218 bp, Homo sapiens; identical to SEQ ID NO: 89880
  chr22:50242294-50242512
  Hyper

SEQ ID NO: 121621 - DNA, 966 bp, Homo sapiens
  chr22:50242712-50243678
  Hyper
tcctggggaggtgcccggtgtggggtgtttctggttcgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtgggcgcaggagaaccaggggtcctgcccgcatgcaggggtttggggtcggtgtggccgaatgaacgcgcgggttcagacgagcctgtgatgcccccgctttccatctcctcgcgacctggccccagaagacagtctgagaggccggtggccgcggatc

SEQ ID NO: 121622 - DNA, 89 bp, Homo sapiens; identical to SEQ ID NO: 89883
  chr22:50251106-50251195
  Hypo

SEQ ID NO: 121623 - DNA, 218 bp, Homo sapiens; identical to SEQ ID NO: 89884
  chr22:50294626-50294844
  Hypo

SEQ ID NO: 121624 - DNA, 30 bp, Homo sapiens; identical to SEQ ID NO: 89885
  chr22:50297116-50297146
  Hypo

SEQ ID NO: 121625 - DNA, 30 bp, Homo sapiens; identical to SEQ ID NO: 89886
  chr22:50297790-50297820
  Hypo

SEQ ID NO: 121626 - DNA, 30 bp, Homo sapiens; identical to SEQ ID NO: 89887
  chr22:50310723-50310753
  Hypo

SEQ ID NO: 121627 - DNA, 65 bp, Homo sapiens; identical to SEQ ID NO: 89888
  chr22:50316873-50316938
  Hypo

SEQ ID NO: 121628 - DNA, 180 bp, Homo sapiens; identical to SEQ ID NO: 89889
  chr22:50421861-50422041
  Hyper

SEQ ID NO: 121629 - DNA, 30 bp, Homo sapiens; identical to SEQ ID NO: 89890
  chr22:50436010-50436040
  Hypo

SEQ ID NO: 121630 - DNA, 45 bp, Homo sapiens; identical to SEQ ID NO: 89891
  chr22:50436676-50436721
  Hypo

SEQ ID NO: 121631 - DNA, 30 bp, Homo sapiens; identical to SEQ ID NO: 46862
  chr22:50439060-50439090
  Hypo

SEQ ID NO: 121632 - DNA, 30 bp, Homo sapiens; identical to SEQ ID NO: 89893
  chr22:50447897-50447927
  Hypo

SEQ ID NO: 121633 - DNA, 82 bp, Homo sapiens; identical to SEQ ID NO: 89894
  chr22:50453457-50453539
  Hyper

SEQ ID NO: 121634 - DNA, 275 bp, Homo sapiens; identical to SEQ ID NO: 89895
  chr22:50466770-50467045
  Hypo

SEQ ID NO: 121635 - DNA, 300 bp, Homo sapiens; identical to SEQ ID NO: 89896
  chr22:50469755-50470055
  Hypo

SEQ ID NO: 121636 - DNA, 268 bp, Homo sapiens; identical to SEQ ID NO: 89897
  chr22:50470497-50470765
  Hypo

SEQ ID NO: 121637 - DNA, 42 bp, Homo sapiens; identical to SEQ ID NO: 89898
  chr22:50482195-50482237
  Hypo

SEQ ID NO: 121638 - DNA, 110 bp, Homo sapiens; identical to SEQ ID NO: 89899
  chr22:50484380-50484490
  Hypo

SEQ ID NO: 121639 - DNA, 48 bp, Homo sapiens; identical to SEQ ID NO: 89900
  chr22:50484839-50484887
  Hypo

SEQ ID NO: 121640 - DNA, 106 bp, Homo sapiens; identical to SEQ ID NO: 89901
  chr22:50488454-50488560
  Hypo

SEQ ID NO: 121641 - DNA, 655 bp, Homo sapiens
  chr22:50496728-50497383
  Hyper
cggggcgtggggctgcgcgggcggcggggggcgcgggggcgcggggagctgcggcgtgcggggggcgcgggccccgacgggcagcagtcatcagcgcttgggctgggcccgggttggggtccgggtcccgggctgctgtcggagcaggcgcggctgcggggtcggcggcgcgggacggtgcgcgccatggtgtccgccgggggagggcccgagtgtagccccgggtcacgcgctgcggccccgcgcccccctgtggaggtcacactccatcccccaccaggtcacaaagacccgcgggtcacatcctgcccctccccctcgggccccccaggcccgccaggccttctcgccctccccggggccctcatgccgccctctgtccctgggcccttccccgacgcgaggctggagcggcggggtgaggaggccgcgggcgctgggctcctcccgggctgcgcgctgcgggtcctggcggatgggggcgacggggtgaccgtatcagcgccccccgtcctgcggcggaacttgggagggccttggtatccgcagaaccactcgtggggtcccacgccgctgccccccggggggttctgagcccacccaggtccacacggcccctgtcgtttccccccgcaccccgcggatcaccccgcca

SEQ ID NO: 121642 - DNA, 160 bp, Homo sapiens; identical to SEQ ID NO: 89904
  chr22:50506998-50507158
  Hypo

SEQ ID NO: 121643 - DNA, 102 bp, Homo sapiens; identical to SEQ ID NO: 89905
  chr22:50509901-50510003
  Hypo

SEQ ID NO: 121644 - DNA, 57 bp, Homo sapiens; identical to SEQ ID NO: 46867
  chr22:50512688-50512745
  Hypo

SEQ ID NO: 121645 - DNA, 30 bp, Homo sapiens; identical to SEQ ID NO: 89907
  chr22:50513114-50513144
  Hypo

SEQ ID NO: 121646 - DNA, 30 bp, Homo sapiens; identical to SEQ ID NO: 89908
  chr22:50519234-50519264
  Hypo

SEQ ID NO: 121647 - DNA, 30 bp, Homo sapiens; identical to SEQ ID NO: 46868
  chr22:50526328-50526358
  Hypo

SEQ ID NO: 121648 - DNA, 102 bp, Homo sapiens; identical to SEQ ID NO: 89910
  chr22:50529523-50529625
  Hypo

SEQ ID NO: 121649 - DNA, 30 bp, Homo sapiens; identical to SEQ ID NO: 89911
  chr22:50529892-50529922
  Hypo

SEQ ID NO: 121650 - DNA, 53 bp, Homo sapiens; identical to SEQ ID NO: 89912
  chr22:50582627-50582680
  Hypo

SEQ ID NO: 121651 - DNA, 30 bp, Homo sapiens; identical to SEQ ID NO: 89913
  chr22:50587368-50587398
  Hypo

SEQ ID NO: 121652 - DNA, 30 bp, Homo sapiens; identical to SEQ ID NO: 89914
  chr22:50596623-50596653
  Hypo

SEQ ID NO: 121653 - DNA, 30 bp, Homo sapiens; identical to SEQ ID NO: 38621
  chr22:50609166-50609196
  Hyper

SEQ ID NO: 121654 - DNA, 440 bp, Homo sapiens
  chr22:50623582-50624022
  Hyper
acagcgagagtctagcgtcggcgtggctgcggccagccgggtccccctggaggcctccggacgatcggaagtgactgagcgtccgggtccgtgaggccgggggtcggcccgccctaagactcccacctggtcccggttctccgtccgctaggctggccgcggggcccctggggcccgaccttcccggggtgccccaacctgcggcaaggccgaggtcccgctgaggcatgagtcccgggtcggggaccgctctgggccgacccccggaggacggactaggccgatccccagagggaagggggccaggccgaggccatggcagcgcgttccctgatcccgtgttctcggctcctcgcgtcccactatcggctgtccctttcgtgcgggactgacggctcacagaacagttacatttcaatatcattcgactgaaaaccatc

SEQ ID NO: 121655 - DNA, 59 bp, Homo sapiens; identical to SEQ ID NO: 89918
  chr22:50656906-50656965
  Hypo

SEQ ID NO: 121656 - DNA, 457 bp, Homo sapiens; identical to SEQ ID NO: 89919
  chr22:50686455-50686912
  Hypo

SEQ ID NO: 121657 - DNA, 225 bp, Homo sapiens; identical to SEQ ID NO: 89920
  chr22:50695326-50695551
  Hypo

SEQ ID NO: 121658 - DNA, 30 bp, Homo sapiens; identical to SEQ ID NO: 89921
  chr22:50697675-50697705
  Hypo

SEQ ID NO: 121659 - DNA, 229 bp, Homo sapiens; identical to SEQ ID NO: 89922
  chr22:50721136-50721365
  Hypo

SEQ ID NO: 121660 - DNA, 44 bp, Homo sapiens; identical to SEQ ID NO: 89923
  chr22:50721828-50721872
  Hypo

SEQ ID NO: 121661 - DNA, 30 bp, Homo sapiens; identical to SEQ ID NO: 89924
  chr22:50755701-50755731
  Hypo

SEQ ID NO: 121662 - DNA, 126 bp, Homo sapiens; identical to SEQ ID NO: 89925
  chr22:50764712-50764838
  Hypo

SEQ ID NO: 121663 - DNA, 19 bp, Homo sapiens
  chr22:50766201-50766220
  Hypo
cacgtgttggccagacgcg

SEQ ID NO: 121664 - DNA, 78 bp, Homo sapiens; identical to SEQ ID NO: 89927
  chr22:50766520-50766598
  Hypo

SEQ ID NO: 121665 - DNA, 30 bp, Homo sapiens; identical to SEQ ID NO: 89928
  chr22:50873974-50874004
  Hypo

SEQ ID NO: 121666 - DNA, 690 bp, Homo sapiens; identical to SEQ ID NO: 89929
  chr22:50899018-50899708
  Hypo

SEQ ID NO: 121667 - DNA, 30 bp, Homo sapiens; identical to SEQ ID NO: 89930
  chr22:50900202-50900232
  Hypo

SEQ ID NO: 121668 - DNA, 70 bp, Homo sapiens; identical to SEQ ID NO: 89931
  chr22:50900758-50900828
  Hypo

SEQ ID NO: 121669 - DNA, 32 bp, Homo sapiens; identical to SEQ ID NO: 89932
  chr22:50909774-50909806
  Hypo

SEQ ID NO: 121670 - DNA, 40 bp, Homo sapiens; identical to SEQ ID NO: 89933
  chr22:50919589-50919629
  Hyper

SEQ ID NO: 121671 - DNA, 58 bp, Homo sapiens; identical to SEQ ID NO: 89934
  chr22:50922605-50922663
  Hypo

SEQ ID NO: 121672 - DNA, 204 bp, Homo sapiens; identical to SEQ ID NO: 89935
  chr22:50927887-50928091
  Hypo

SEQ ID NO: 121673 - DNA, 169 bp, Homo sapiens; identical to SEQ ID NO: 89936
  chr22:50935672-50935841
  Hypo

SEQ ID NO: 121674 - DNA, 242 bp, Homo sapiens; identical to SEQ ID NO: 89937
  chr22:50943170-50943412
  Hypo

SEQ ID NO: 121675 - DNA, 351 bp, Homo sapiens; identical to SEQ ID NO: 89938
  chr22:50944365-50944716
  Hypo

SEQ ID NO: 121676 - DNA, 32 bp, Homo sapiens; identical to SEQ ID NO: 89939
  chr22:50948627-50948659
  Hypo

SEQ ID NO: 121677 - DNA, 30 bp, Homo sapiens; identical to SEQ ID NO: 89940
  chr22:50954437-50954467
  Hypo

SEQ ID NO: 121678 - DNA, 69 bp, Homo sapiens; identical to SEQ ID NO: 46878
  chr22:50954977-50955046
  Hypo

SEQ ID NO: 121679 - DNA, 41 bp, Homo sapiens; identical to SEQ ID NO: 46879
  chr22:50977129-50977170
  Hypo

SEQ ID NO: 121680 - DNA, 69 bp, Homo sapiens
  chr22:50987052-50987121
  Hyper
accctcaaggggaggcgccgggggaggggggcagccctgccggccgcagcggggcgctcacggaaaagc

SEQ ID NO: 121681 - DNA, 521 bp, Homo sapiens
  chr22:51042260-51042781
  Hyper
gcccagcagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgccgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctca

SEQ ID NO: 121682 - DNA, 32 bp, Homo sapiens; identical to SEQ ID NO: 89946
  chr22:51049120-51049152
  Hypo

SEQ ID NO: 121683 - DNA, 434 bp, Homo sapiens
  chr22:51111883-51112317
  Hyper
agtgcaggacagttccgagaggccgctcagggctggggggcctggtgcaccccgatggggcggcggtgcctgagctcgtttctttactgagctcccccctcctccgcccactcatcaccccctcccgcgttgccacgacaacgcgtaaaactaaaattcacttcccagtcgcaggtggagactagtagcgccccctcccctaggcccttccccgtaggtcgcgcccccatcccgccgtcgctaaggtgacggggagggggcgacaggcgttggatccggaccggccaggggtccttggggggaagtccggagcaaactccccaaactaggctggcgtgggggagccgcgccgaacacgccagggcgcggtcgaaagggttaattcggagggcctctcgccgaggcggtgggaagggccccgggccctccccggt

SEQ ID NO: 121684 - DNA, 46 bp, Homo sapiens; identical to SEQ ID NO: 89949
  chr22:51113404-51113450
  Hyper

SEQ ID NO: 121685 - DNA, 110 bp, Homo sapiens; identical to SEQ ID NO: 89950
  chr22:51144325-51144435
  Hypo

SEQ ID NO: 121686 - DNA, 45 bp, Homo sapiens; identical to SEQ ID NO: 89951
  chr22:51181429-51181474
  Hypo

SEQ ID NO: 121687 - DNA, 2067 bp, Homo sapiens
  chr3:238195-240262
  Hyper
gtgtgcaacatgaaccgagtgaaaccatcggggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgtgtcaggggtgggggtccgctggcatctctcgtgccggcgctgggggggtctcccgtggaggaagggctgaaggtgctccgggaggggtccactcgttatggaaaggaagcggggcgcggtcagggtccctcgtccgcagtgggggtggtccgggcccctcagcctgcacccgggaggagacgcccccttttcacgccccgcccccggtggccgaggccggattcggacagctcggggtcagtcgacggagcacaccgggcgcccgaatccgccgggtcccactcacgcccgccggccgccggtaggttggccctcccgcttccagcctccgccaccccatccctcgctgctctctgaggaggattccagacccccccgtagatctccgccctctctcgggtggggctccgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatac

SEQ ID NO: 121688 - DNA, 30 bp, Homo sapiens; identical to SEQ ID NO: 39848
  chr3:1741068-1741098
  Hypo

SEQ ID NO: 121689 - DNA, 1687 bp, Homo sapiens
  chr3:2139709-2141396
  Hyper
gaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccccggttcagcaattttcagcccagacgcagaagcatctgtttccctggccagggcgccttaacgatcccccgaattccgcgtctcccggaggccagaggtttgggtacccaggaaggtcgcgcctcctcgtgccccgatactcgggttgtaaagggaggagacatcgcctcggcgcatccctggccgctgaacaacgcaacccctacgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagcgtctcccccgccccgcggctaaggagccggcagcccgaactccggcgcgccaggtttttccagccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaactt

SEQ ID NO: 121690 - DNA, 30 bp, Homo sapiens; identical to SEQ ID NO: 90976
  chr3:2523208-2523238
  Hypo

SEQ ID NO: 121691 - DNA, 191 bp, Homo sapiens; identical to SEQ ID NO: 39849
  chr3:2909417-2909608
  Hypo

SEQ ID NO: 121692 - DNA, 18 bp, Homo sapiens
  chr3:3100258-3100276
  Hypo
acccggcccttaaggccc

SEQ ID NO: 121693 - DNA, 78 bp, Homo sapiens; identical to SEQ ID NO: 90999
  chr3:3167655-3167733
  Hypo

SEQ ID NO: 121694 - DNA, 30 bp, Homo sapiens; identical to SEQ ID NO: 39851
  chr3:3167988-3168018
  Hypo

SEQ ID NO: 121695 - DNA, 2178 bp, Homo sapiens; identical to SEQ ID NO: 91044
  chr3:3840430-3842608
  Hyper

SEQ ID NO: 121696 - DNA, 30 bp, Homo sapiens; identical to SEQ ID NO: 91056
  chr3:4071112-4071142
  Hypo

SEQ ID NO: 121697 - DNA, 30 bp, Homo sapiens; identical to SEQ ID NO: 91117
  chr3:4697393-4697423
  Hypo

SEQ ID NO: 121698 - DNA, 30 bp, Homo sapiens; identical to SEQ ID NO: 39852
  chr3:4755974-4756004
  Hypo

SEQ ID NO: 121699 - DNA, 125 bp, Homo sapiens; identical to SEQ ID NO: 91127
  chr3:4799808-4799933
  Hypo

SEQ ID NO: 121700 - DNA, 262 bp, Homo sapiens; identical to SEQ ID NO: 28034
  chr3:4910288-4910550
  Hyper

SEQ ID NO: 121701 - DNA, 30 bp, Homo sapiens; identical to SEQ ID NO: 91156
  chr3:4992934-4992964
  Hypo

SEQ ID NO: 121702 - DNA, 147 bp, Homo sapiens; identical to SEQ ID NO: 91159
  chr3:5018985-5019132
  Hyper

SEQ ID NO: 121703 - DNA, 240 bp, Homo sapiens; identical to SEQ ID NO: 91176
  chr3:5137779-5138019
  Hyper

SEQ ID NO: 121704 - DNA, 30 bp, Homo sapiens; identical to SEQ ID NO: 91207
  chr3:5442940-5442970
  Hypo

SEQ ID NO: 121705 - DNA, 195 bp, Homo sapiens; identical to SEQ ID NO: 91208
  chr3:5496299-5496494
  Hypo

SEQ ID NO: 121706 - DNA, 91 bp, Homo sapiens; identical to SEQ ID NO: 91226
  chr3:5831049-5831140
  Hypo

SEQ ID NO: 121707 - DNA, 30 bp, Homo sapiens; identical to SEQ ID NO: 39854
  chr3:5970953-5970983
  Hypo

SEQ ID NO: 121708 - DNA, 66 bp, Homo sapiens; identical to SEQ ID NO: 91283
  chr3:6901993-6902059
  Hyper

SEQ ID NO: 121709 - DNA, 351 bp, Homo sapiens; identical to SEQ ID NO: 91284
  chr3:6902321-6902672
  Hyper

SEQ ID NO: 121710 - DNA, 147 bp, Homo sapiens
  chr3:6902969-6903116
  Hyper
gcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgat

SEQ ID NO: 121711 - DNA, 122 bp, Homo sapiens; identical to SEQ ID NO: 91286
  chr3:6903588-6903710
  Hyper

SEQ ID NO: 121712 - DNA, 378 bp, Homo sapiens
  chr3:6904142-6904520
  Hyper
ctcgggctgatttcccgacctgtagccagcctccgcgagagcccagggcgcgaggtgctgggaccttcctcaggtggagagatgctgcccgcagacgtgacccccggttggtttgctccgggcaatattttgcaccgtctaaattacatgtgcgatccggccactggccggagctgggcgatcagctttccactcctgccacttcagacctcagcccagggatgagctcacgcgaaacgaaatcgctctccctgcctcctccctcctcccccccgcccccctcacccactatctccctgacgcagaccccaagccaaatcctcggcttggaggacgattcccggagcgaggcatgaaggcgcccgttgggaggcagag

SEQ ID NO: 121713 - DNA, 43 bp, Homo sapiens; identical to SEQ ID NO: 91312
  chr3:7271788-7271831
  Hypo

SEQ ID NO: 121714 - DNA, 30 bp, Homo sapiens; identical to SEQ ID NO: 91326
  chr3:7630527-7630557
  Hypo

SEQ ID NO: 121715 - DNA, 20 bp, Homo sapiens
  chr3:7690771-7690791
  Hypo
tttgagatggagtctcgctc

SEQ ID NO: 121716 - DNA, 905 bp, Homo sapiens
  chr3:8809378-8810283
  Hyper
caggcagccgagccacgtggcgagcactgccaggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagcgccaggagcaggatgagacacagcaccgccacctccacgcgcgccagggcctcgttgcgccgcgggggtccggcggtgcggttgccctcggcccccggcggcgcggcgctggcgttggctgcctcggcgctccagttggctgcgagcgcgccctccatgaccctggcggcagcggtgcgccccggccttcgagccctttacggcttggcgcggctgggccggatccggcgtgtcggagggtgtaggggcgcccggggctccactcctggagactccacggacggatctgctgggtccaccctgaaacaaaccgggagggccgtgaggagaccgccgcgtttctcttccgacgcgggtagggcgtgcttgtcccattcccaggaacccaactcatctgaaacaacagggcacaaccgccggcctcgggttgctcagccgccaccccagaaatccccgttggaggtacctcctctgagccactgcaaatgagcgggaatcctctaccggccacaagcccagagcccccagcgtgccagttcctcgggatgttcagcggcttccactgggg

SEQ ID NO: 121717 - DNA, 693 bp, Homo sapiens; identical to SEQ ID NO: 91356
  chr3:8810758-8811451
  Hyper

SEQ ID NO: 121718 - DNA, 30 bp, Homo sapiens; identical to SEQ ID NO: 39855
  chr3:9006374-9006404
  Hypo

SEQ ID NO: 121719 - DNA, 322 bp, Homo sapiens
  chr3:9177880-9178202
  Hyper
cacaaaagactcgtgcgctgcccggacacgggctccccattgccgcccttctcctagcctcctgtacaccgagaggcggcttccgggacggccccgagggtccgcaggatccgtgcgcccagcgccggggctggaggcagcagatgccgggccggggtcagccgccgcgcgccgttgccacggcaaccgtcgctgggaccccccccccccccgaccgccccgccccgccccgcgcgccacgtgcagcagccggggtggctgaaagcgggctcctaagccatctcttcggattccttcttcgcagacgcgagcaagctcctgg

SEQ ID NO: 121720 - DNA, 680 bp, Homo sapiens; identical to SEQ ID NO: 91367
  chr3:9541700-9542380
  Hyper

SEQ ID NO: 121721 - DNA, 118 bp, Homo sapiens
  chr3:9550635-9550753
  Hyper
ctggtcgtccattcccgtggtgccagaggcgcgggtcctgcagtagtcggtggctcccgccaggagcatccccgtctccgtggaaaccgggcctgcatcccggcgctcccagctgcgc

SEQ ID NO: 121722 - DNA, 93 bp, Homo sapiens; identical to SEQ ID NO: 91369
  chr3:9593963-9594056
  Hyper

SEQ ID NO: 121723 - DNA, 77 bp, Homo sapiens; identical to SEQ ID NO: 91370
  chr3:9594366-9594443
  Hyper

SEQ ID NO: 121724 - DNA, 30 bp, Homo sapiens; identical to SEQ ID NO: 91371
  chr3:9594966-9594996
  Hyper

SEQ ID NO: 121725 - DNA, 432 bp, Homo sapiens
  chr3:9595249-9595681
  Hyper
cggggggctggggagcggccgggcccgagtagggccggggttgggggggcggctgccccgcgcccaggccggacgcgcgcgaggctgcggccgcggggaaagggtgcggggagaccaacctgggcacggccggaggcagcggatccgggactggcacggcctaggcgccgcggctcggcgctcccagcagcggctgcctcggcccaggcggcggcctctgcgcggcctccatcttgctcgggttctccccggggcgcgctcccgcgccgaggcgcgcgctctcgtgcaccggcgcggcccggcggaggcgcgctcccgagcgggcgtgcgggacggggcggggcggaaccggggaagggtgctcctggttctggcagttggggggaagggtggccacgatacctggggtcccccagccggggcagcaagcac

SEQ ID NO: 121726 - DNA, 470 bp, Homo sapiens; identical to SEQ ID NO: 91378
  chr3:9745353-9745823
  Hyper

SEQ ID NO: 121727 - DNA, 55 bp, Homo sapiens; identical to SEQ ID NO: 91379
  chr3:9746288-9746343
  Hyper

SEQ ID NO: 121728 - DNA, 29 bp, Homo sapiens
  chr3:9886216-9886245
  Hypo
agcttccccagctcacgattgtccaacct

SEQ ID NO: 121729 - DNA, 489 bp, Homo sapiens; identical to SEQ ID NO: 91395
  chr3:9904219-9904708
  Hyper

SEQ ID NO: 121730 - DNA, 41 bp, Homo sapiens; identical to SEQ ID NO: 91397
  chr3:9941469-9941510
  Hypo

SEQ ID NO: 121731 - DNA, 1064 bp, Homo sapiens; identical to SEQ ID NO: 91398
  chr3:9956682-9957746
  Hyper

SEQ ID NO: 121732 - DNA, 414 bp, Homo sapiens
  chr3:9993715-9994129
  Hyper
ggctgtggggggtggcggatctctctgccgcagggactggggagaggccggcctgggggcagggcgaggccgttgcggggcagcctcggagctggtccatctcgggttacctctcctcctcctcctcctcctcctccgtctcctctctccctggctccgcgccttcccgcagtgtcctggatgggggtgggcgccgtgcaggcctggtcgcctgcgcccgcgacgggggcagcaggccacgctccccgtcggggtcccgccatcgccccctccctgggccagctcctcacctgcgcgccgcagcccccgtgttcaccttgcgcgcgtccctgcagccgatcgccgcgccgcatcctccgagatgctcagactcggctaacagagcccggcgctgccgatcgcgagcccgcccac

SEQ ID NO: 121733 - DNA, 30 bp, Homo sapiens; identical to SEQ ID NO: 39857
  chr3:10127378-10127408
  Hypo

SEQ ID NO: 121734 - DNA, 30 bp, Homo sapiens; identical to SEQ ID NO: 89958
  chr3:10129903-10129933
  Hypo

SEQ ID NO: 121735 - DNA, 24 bp, Homo sapiens
  chr3:10156881-10156905
  Hypo
gcaagactccgtctcaaaaaaaca

SEQ ID NO: 121736 - DNA, 78 bp, Homo sapiens
  chr3:10182839-10182917
  Hypo
ttgtactttataagcgtgatgattgggtgttcccgtgtgagatgcgccaccctcgaaccttgttacgacgtcggcaca

SEQ ID NO: 121737 - DNA, 29 bp, Homo sapiens
  chr3:10183321-10183350
  Hyper
cgcctccgttacaacggcctacggtgctg

SEQ ID NO: 121738 - DNA, 29 bp, Homo sapiens
  chr3:10183706-10183735
  Hyper
cgcggcccgtgctgcgctcggtgaactcg

SEQ ID NO: 121739 - DNA, 444 bp, Homo sapiens; identical to SEQ ID NO: 89962
  chr3:10206755-10207199
  Hyper

SEQ ID NO: 121740 - DNA, 25 bp, Homo sapiens
  chr3:10210615-10210640
  Hypo
tcaggggaaccagcccgcagtattt

SEQ ID NO: 121741 - DNA, 30 bp, Homo sapiens; identical to SEQ ID NO: 89965
  chr3:10332154-10332184
  Hypo

SEQ ID NO: 121742 - DNA, 30 bp, Homo sapiens; identical to SEQ ID NO: 89966
  chr3:10373144-10373174
  Hypo

SEQ ID NO: 121743 - DNA, 36 bp, Homo sapiens; identical to SEQ ID NO: 89967
  chr3:10434940-10434976
  Hypo

SEQ ID NO: 121744 - DNA, 55 bp, Homo sapiens; identical to SEQ ID NO: 89969
  chr3:10452238-10452293
  Hypo

SEQ ID NO: 121745 - DNA, 102 bp, Homo sapiens; identical to SEQ ID NO: 89970
  chr3:10547163-10547265
  Hyper

SEQ ID NO: 121746 - DNA, 744 bp, Homo sapiens; identical to SEQ ID NO: 89980
  chr3:10749201-10749945
  Hyper

SEQ ID NO: 121747 - DNA, 794 bp, Homo sapiens
  chr3:10857625-10858419
  Hyper
ggagccggcctaggccggaatgggcgcttccactcttggcccagcaggccagtgggcagggccgcgggaaggacgggcgctgcaggggctccgcgcgctcaaggtgctcgcgggctcccgggcccagccgggctgaggtggcgtgggcgccctgcgggccgggcctccgcggcgcgtcccagtcccagtctccgcgctggtctggcccggtccctcagctccaccccctgcctccccctcccgcccgctcgcgcctcctgaaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggtgaggtgatagtgaggagaaggggagggggcgccaaccgcccggtgggggcggggagccaggggcgagcgcgagaccccctcccgcgcctgcgtggagcggaacccgagcggagaacctcgactccaggcacctcgcgtgtgagctcgccccggagcgcggcccacctgtgccagtgcgcacgcgcacgtgccaattcgcacctgagggttc

SEQ ID NO: 121748 - DNA, 41 bp, Homo sapiens; identical to SEQ ID NO: 89990
  chr3:11033835-11033876
  Hyper

SEQ ID NO: 121749 - DNA, 1288 bp, Homo sapiens
  chr3:11034146-11035434
  Hyper
ggagggagaagagagcgggagaatgcgagaggaaagaagggagaggggaggcgtagaaggggagaggaggtgaagggaaaaggagagagcctgctggcggcgaagctgcaagaggcagctgcggagggagcgcgcggcgggcctgggggagcgctgggcgggggcgggcggtgcgggcagggctatacccgagctgggcgggctccgggcgccgcgggccctgccctccccctccatccctccggactcgctcccccctcctctcccttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggtaggaaagggcggccggcgtcggggcgcggggcgcagagcctgggataacggcgcaggaacggccagagccccgagccgctgccgcgagccgggccgggtggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccccggcgcgacaccgctcaccacggtagcctcgggcagtgcccattgggttctgagcacacgtccccacgggtggcacccaca

SEQ ID NO: 121750 - DNA, 51 bp, Homo sapiens; identical to SEQ ID NO: 89994
  chr3:11062025-11062076
  Hypo

SEQ ID NO: 121751 - DNA, 360 bp, Homo sapiens; identical to SEQ ID NO: 89999
  chr3:11196531-11196891
  Hyper

SEQ ID NO: 121752 - DNA, 94 bp, Homo sapiens; identical to SEQ ID NO: 90016
  chr3:11581322-11581416
  Hypo

SEQ ID NO: 121753 - DNA, 56 bp, Homo sapiens; identical to SEQ ID NO: 90017
  chr3:11600778-11600834
  Hypo

SEQ ID NO: 121754 - DNA, 35 bp, Homo sapiens; identical to SEQ ID NO: 90020
  chr3:11658975-11659010
  Hypo

SEQ ID NO: 121755 - DNA, 30 bp, Homo sapiens; identical to SEQ ID NO: 90021
  chr3:11683213-11683243
  Hyper

SEQ ID NO: 121756 - DNA, 37 bp, Homo sapiens; identical to SEQ ID NO: 90023
  chr3:11706859-11706896
  Hypo

SEQ ID NO: 121757 - DNA, 218 bp, Homo sapiens; identical to SEQ ID NO: 90024
  chr3:11763029-11763247
  Hypo

SEQ ID NO: 121758 - DNA, 30 bp, Homo sapiens; identical to SEQ ID NO: 39861
  chr3:12039968-12039998
  Hypo

SEQ ID NO: 121759 - DNA, 951 bp, Homo sapiens
  chr3:12045681-12046632
  Hyper
gctggaggcctgggtcgccccctcctgcaagccccgagagtcgccagacgcgcggctaggtgccctccgtgagcggggcggggccgcctctgcggcgcggggcgggggctatctctggccccgcccctgccccgcccgctccctctccgcgagcctcgcgccgcgcgggttgcctggcccagaccgccgctgctgtctgcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaagcgccgacgccgccgccccccggcccgggcgccgcctcggcctaggcggcgcccccgaccgcctcgccgggaccggagcggacgccgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtggacgcgcccggtgccgcgccggcagccgccaggaaggccaaggtgctgctggtggtcgacgagccgcacgccgactggtaggtgccgggcgccttcgccctcgggggtcggggtccgccggcagccgcaggccaggagaggacggtcccaggtcgccgaggaaacgtttcagaccaataaaaaggagggtccccgaggtcccgctgggaggaggtgcgggctgagcgcgcgcgcgtttgcggggtgagggagggcatccatcagcccggaaaggcgaaccc

SEQ ID NO: 121760 - DNA, 543 bp, Homo sapiens; identical to SEQ ID NO: 90076
  chr3:12329482-12330025
  Hyper

SEQ ID NO: 121761 - DNA, 30 bp, Homo sapiens; identical to SEQ ID NO: 14520
  chr3:12586227-12586257
  Hypo

SEQ ID NO: 121762 - DNA, 26 bp, Homo sapiens
  chr3:12596518-12596544
  Hypo
gtggcatgggctgggcgcggtggctc

SEQ ID NO: 121763 - DNA, 102 bp, Homo sapiens; identical to SEQ ID NO: 90111
  chr3:12673087-12673189
  Hypo

SEQ ID NO: 121764 - DNA, 240 bp, Homo sapiens; identical to SEQ ID NO: 90153
  chr3:12837883-12838123
  Hyper

SEQ ID NO: 121765 - DNA, 30 bp, Homo sapiens
  chr3:12838460-12838490
  Hyper
cactggagctccggccgttctcccctaggg

SEQ ID NO: 121766 - DNA, 82 bp, Homo sapiens; identical to SEQ ID NO: 90155
  chr3:12851610-12851692
  Hyper

SEQ ID NO: 121767 - DNA, 382 bp, Homo sapiens; identical to SEQ ID NO: 90159
  chr3:12867117-12867499
  Hypo

SEQ ID NO: 121768 - DNA, 36 bp, Homo sapiens; identical to SEQ ID NO: 90160
  chr3:12870958-12870994
  Hypo

SEQ ID NO: 121769 - DNA, 36 bp, Homo sapiens; identical to SEQ ID NO: 90180
  chr3:12915182-12915218
  Hypo

SEQ ID NO: 121770 - DNA, 170 bp, Homo sapiens; identical to SEQ ID NO: 90181
  chr3:12917547-12917717
  Hyper

SEQ ID NO: 121771 - DNA, 30 bp, Homo sapiens; identical to SEQ ID NO: 90193
  chr3:12977045-12977075
  Hypo

SEQ ID NO: 121772 - DNA, 85 bp, Homo sapiens; identical to SEQ ID NO: 90197
  chr3:13008938-13009023
  Hyper

SEQ ID NO: 121773 - DNA, 162 bp, Homo sapiens; identical to SEQ ID NO: 90198
  chr3:13009525-13009687
  Hyper

SEQ ID NO: 121774 - DNA, 42 bp, Homo sapiens; identical to SEQ ID NO: 90199
  chr3:13021222-13021264
  Hypo

SEQ ID NO: 121775 - DNA, 30 bp, Homo sapiens; identical to SEQ ID NO: 90203
  chr3:13028860-13028890
  Hypo

SEQ ID NO: 121776 - DNA, 46 bp, Homo sapiens; identical to SEQ ID NO: 90209
  chr3:13083152-13083198
  Hypo

SEQ ID NO: 121777 - DNA, 120 bp, Homo sapiens; identical to SEQ ID NO: 90210
  chr3:13083986-13084106
  Hypo

SEQ ID NO: 121778 - DNA, 61 bp, Homo sapiens; identical to SEQ ID NO: 90211
  chr3:13096348-13096409
  Hypo

SEQ ID NO: 121779 - DNA, 30 bp, Homo sapiens; identical to SEQ ID NO: 90218
  chr3:13177731-13177761
  Hypo

SEQ ID NO: 121780 - DNA, 1519 bp, Homo sapiens
  chr3:13323423-13324942
  Hyper
cctgccccagatgggcgcccgaaggtccacacggtgaggctgctccgggtttcgacaccgacactcatgggaggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctgggcggcgaccccgccagagaatcccagggagcccctgggggtctggcggcgggtgtgggcgctcccgggccggccacgcgccctcccgcacccgcccacctccccgccaagccccgagggaagccgcggaccccaagaagttcccacgtccccgacacgcccgccgccccgggccccgcttacttgtcgcggcggccgccgagctccgggatggcgccgagcggctgcgggccggggccggggcccgggtcggggcggcgggcgcacgcggccaggtgtcgccggtgtcgctccagcaggccggcgttctcccggctcagccgcgccacttggcgctccagctcctcgatgcgccgtcgccggcgcgccagcagctcctgctgcgcggcgacgatccgggtcagctcctgcaggtactcggccgcctggccggggggctcggcggcgctggccatggccccccgcccggaggccggccgcgcctcaggcgagcgggcggcggggcggcggcggcgcggccatggctgcgcggcggggacggcggctcggcgcggcgcggggctgccgcggccccgcctcggctcccgcctccgccggcgccgcccccggggcccccgcgcctcctgctccccgcgccgccgcgctccgccgcccgctgccccgcggacgcgccggggcggcagggcgcggagctgcggccgcagcgggcaggcgaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcggacgattttaggaaaag

SEQ ID NO: 121781 - DNA, 68 bp, Homo sapiens; identical to SEQ ID NO: 90234
  chr3:13357887-13357955
  Hypo

SEQ ID NO: 121782 - DNA, 72 bp, Homo sapiens; identical to SEQ ID NO: 90235
  chr3:13359589-13359661
  Hypo

SEQ ID NO: 121783 - DNA, 52 bp, Homo sapiens; identical to SEQ ID NO: 90241
  chr3:13367368-13367420
  Hypo

SEQ ID NO: 121784 - DNA, 42 bp, Homo sapiens; identical to SEQ ID NO: 39868
  chr3:13373208-13373250
  Hypo

SEQ ID NO: 121785 - DNA, 86 bp, Homo sapiens; identical to SEQ ID NO: 90256
  chr3:13442743-13442829
  Hypo

SEQ ID NO: 121786 - DNA, 152 bp, Homo sapiens; identical to SEQ ID NO: 90265
  chr3:13546000-13546152
  Hypo

SEQ ID NO: 121787 - DNA, 635 bp, Homo sapiens
  chr3:13590416-13591051
  Hyper
ggcgcagggagggtgcgggctccgcagcgagcgcgccgggcggcctctaggagccgggtcagcgagtctgggctctgagcgagcggcgccggcccggccccctctccggcgggcggccgagaccccgccccggaggcggaggcggagtcaggggagggggccgggggccggctggtcccgcctctcgcgcctccgccccgccccgcgcgcacacagccaggggccgcccgggctctcgacgcgccgacggccgggcggacggacggacggacgccgagcgcagtgccccgcggtgagtgcacgcggcccctcccgcccggactcatccccgtcggtccgcgcctcgcagctcaggactcgggggcgctcggacgcaccgacggctcggcggaccctcggacgcgcctcgcgggctgcccgcgcctccacccgcgccgccggtccgaccgggtctcgctctcccggtcccagcgcggggacggcccgcgagcgccgcgacccagtgtacagatgcgggcacagaggccggcgcggggtgggggccaggggtccgcgggcgggttcccccaccccaggtccgcagcttcctccgctctgggtttcacttctcccccctgggccggctcccaccagtc

SEQ ID NO: 121788 - DNA, 332 bp, Homo sapiens; identical to SEQ ID NO: 90271
  chr3:13612009-13612341
  Hypo

SEQ ID NO: 121789 - DNA, 312 bp, Homo sapiens; identical to SEQ ID NO: 90278
  chr3:13679132-13679444
  Hypo

SEQ ID NO: 121790 - DNA, 30 bp, Homo sapiens; identical to SEQ ID NO: 14522
  chr3:13680779-13680809
  Hypo

SEQ ID NO: 121791 - DNA, 410 bp, Homo sapiens
  chr3:13696612-13697022
  Hyper
caggtagccccaggacggcgctgcagcaggagtgtccctgatcccgggtggtcgctctccagcccgccaggctctccgacgggctcaacccgcagcccctggccggggctggggccgggacgccaggcccctgtggggacggttccctccagcagttggcgaggctcggccggccaaggggccggttcctcccgctggcagccgcccggccgccgccttccgcccttgcccgcccgcggccgtccccgagccgctcccggccgggccttgagcgccttttcctcttcccggcgccccggccgcccggcgcgtccagctaagcaggaagggcccgcccgcgcccaaggccagggcctcagccggaggtcgcccgccgccaggggccgctgcggcgccggggacgcgcgagg

SEQ ID NO: 121792 - DNA, 163 bp, Homo sapiens; identical to SEQ ID NO: 90306
  chr3:13860677-13860840
  Hypo

SEQ ID NO: 121793 - DNA, 1122 bp, Homo sapiens; identical to SEQ ID NO: 90329
  chr3:13919657-13920779
  Hyper

SEQ ID NO: 121794 - DNA, 923 bp, Homo sapiens; identical to SEQ ID NO: 90330
  chr3:13920980-13921903
  Hyper

SEQ ID NO: 121795 - DNA, 30 bp, Homo sapiens; identical to SEQ ID NO: 90332
  chr3:13937220-13937250
  Hyper

SEQ ID NO: 121796 - DNA, 99 bp, Homo sapiens; identical to SEQ ID NO: 90337
  chr3:13975514-13975613
  Hypo

SEQ ID NO: 121797 - DNA, 30 bp, Homo sapiens; identical to SEQ ID NO: 39874
  chr3:14197900-14197930
  Hypo

SEQ ID NO: 121798 - DNA, 161 bp, Homo sapiens; identical to SEQ ID NO: 39875
  chr3:14443179-14443340
  Hypo

SEQ ID NO: 121799 - DNA, 30 bp, Homo sapiens; identical to SEQ ID NO: 90397
  chr3:14552752-14552782
  Hypo

SEQ ID NO: 121800 - DNA, 39 bp, Homo sapiens; identical to SEQ ID NO: 90404
  chr3:14615548-14615587
  Hypo

SEQ ID NO: 121801 - DNA, 883 bp, Homo sapiens; identical to SEQ ID NO: 90407
  chr3:14643752-14644635
  Hyper

SEQ ID NO: 121802 - DNA, 30 bp, Homo sapiens; identical to SEQ ID NO: 39876
  chr3:14676121-14676151
  Hypo

SEQ ID NO: 121803 - DNA, 1192 bp, Homo sapiens
  chr3:14851814-14853006
  Hyper
cccagaaacccaactcgctgagttctcgtccttcgaacccccagcgcctcccgcggtgcccatggccacggcccctttaaatgtgcgcagggacgccccggccctcgcctccctgaatctctgaccgagcaggggaaaaaaaaatccttcctcttcgggagcggaggaaatgtctaggagggggtggaggcgcggctgcggcgcaggcagaggcgcaggcggaggcacggcggccagagcgcagcgcgcccggagccgggagcggacgcgacgcccggcgctgccccagccgccgcccccgcgctcgcgccccctcctcctcccccgccccgcgcccccgcccggcggccccgccccggaggctcgcggctcgcgcccccactgccctgcgcgccgcgcggagtccgaggcgcgccggggccgggcgggcgccagggggtgcgggccccgcggggcggccgcggagggaggcggtgtgcggagtcgcactgggacccgcggacggactgaaacgccgacggcggcccgggccccgcgcgctgaagatgaacagagcaggtaggaggcccggcgacctccggcgccgaggcacgagcgcgagggaccccggccgggcgctccaagttggagctcccggggagcccggggctagctgcccgaaatcctccgaccttccagtgccgctcggcctcggccaaagcatgcgcggctccggggtcctctcgccgaggaggctgagaaccgggggtccccgtccgaagcgccctgcctcagggaccttctcagccttggcgaggccgcgccctggccgtgcgcgccagtatcccactcgcacggcgttccccggagtgagggtcccttccacgacgaagaaagacgcccctttcgcaaaagcgacttcgtctggccccaaaacctttgccctccattccccagcgtcccggaccggtccttgctcatctctcaggggcaacacctgacccacggggcccgtcccggagctctcttcgactccgggaccagttcccagcccttcagtactcggcataccggaaggaggattcctgctcccttctctcctcctagaccccgaggcttggagcttactctccagatgagactaaaaagccctaaattaatccccctatagcgcacccctccctcgcagcgccctggtcgggggcctccattg

SEQ ID NO: 121804 - DNA, 257 bp, Homo sapiens; identical to SEQ ID NO: 90463
  chr3:14963819-14964076
  Hypo

SEQ ID NO: 121805 - DNA, 37 bp, Homo sapiens; identical to SEQ ID NO: 90476
  chr3:15105526-15105563
  Hypo

SEQ ID NO: 121806 - DNA, 55 bp, Homo sapiens; identical to SEQ ID NO: 90554
  chr3:16220336-16220391
  Hypo

SEQ ID NO: 121807 - DNA, 30 bp, Homo sapiens; identical to SEQ ID NO: 90561
  chr3:16498958-16498988
  Hypo

SEQ ID NO: 121808 - DNA, 1448 bp, Homo sapiens
  chr3:16553978-16555426
  Hyper
actgacaccacccagcgtccctagggatcacccataaccacacagggcagctgagggcaagcacagagtcacagacagacagcagggagcgtgcctggttctacaaccttggcctccacgcggttcttgctgccaaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtcgacaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctccccgcgccccctcggagttccgcccggtcacctccacgcggccgagctgcaagcgaccctggcagcct

SEQ ID NO: 121809 - DNA, 30 bp, Homo sapiens; identical to SEQ ID NO: 90569
  chr3:16727103-16727133
  Hypo

SEQ ID NO: 121810 - DNA, 134 bp, Homo sapiens; identical to SEQ ID NO: 90581
  chr3:16889114-16889248
  Hypo

SEQ ID NO: 121811 - DNA, 37 bp, Homo sapiens; identical to SEQ ID NO: 90582
  chr3:16892948-16892985
  Hypo

SEQ ID NO: 121812 - DNA, 202 bp, Homo sapiens; identical to SEQ ID NO: 90583
  chr3:16894319-16894521
  Hypo

SEQ ID NO: 121813 - DNA, 49 bp, Homo sapiens; identical to SEQ ID NO: 90585
  chr3:16925656-16925705
  Hyper

SEQ ID NO: 121814 - DNA, 30 bp, Homo sapiens; identical to SEQ ID NO: 90586
  chr3:16925935-16925965
  Hyper

SEQ ID NO: 121815 - DNA, 104 bp, Homo sapiens; identical to SEQ ID NO: 90597
  chr3:16952388-16952492
  Hypo

SEQ ID NO: 121816 - DNA, 38 bp, Homo sapiens; identical to SEQ ID NO: 39880
  chr3:17001303-17001341
  Hypo

SEQ ID NO: 121817 - DNA, 31 bp, Homo sapiens; identical to SEQ ID NO: 90611
  chr3:17048624-17048655
  Hypo

SEQ ID NO: 121818 - DNA, 66 bp, Homo sapiens; identical to SEQ ID NO: 14524
  chr3:17499802-17499868
  Hypo

SEQ ID NO: 121819 - DNA, 79 bp, Homo sapiens; identical to SEQ ID NO: 90715
  chr3:18299771-18299850
  Hypo

SEQ ID NO: 121820 - DNA, 526 bp, Homo sapiens; identical to SEQ ID NO: 90768
  chr3:18485126-18485652
  Hyper

SEQ ID NO: 121821 - DNA, 231 bp, Homo sapiens; identical to SEQ ID NO: 28092
  chr3:18486970-18487201
  Hyper

SEQ ID NO: 121822 - DNA, 35 bp, Homo sapiens; identical to SEQ ID NO: 90809
  chr3:18735758-18735793
  Hypo

SEQ ID NO: 121823 - DNA, 148 bp, Homo sapiens; identical to SEQ ID NO: 90827
  chr3:19188145-19188293
  Hyper

SEQ ID NO: 121824 - DNA, 799 bp, Homo sapiens; identical to SEQ ID NO: 90828
  chr3:19189373-19190172
  Hyper

SEQ ID NO: 121825 - DNA, 34 bp, Homo sapiens; identical to SEQ ID NO: 90944
  chr3:19790965-19790999
  Hypo

SEQ ID NO: 121826 - DNA, 106 bp, Homo sapiens; identical to SEQ ID NO: 90945
  chr3:19791264-19791370
  Hypo

SEQ ID NO: 121827 - DNA, 16 bp, Homo sapiens
  chr3:19911550-19911566
  Hypo
gcgtgagctaccacac

SEQ ID NO: 121828 - DNA, 39 bp, Homo sapiens; identical to SEQ ID NO: 90947
  chr3:20013231-20013270
  Hypo

SEQ ID NO: 121829 - DNA, 20 bp, Homo sapiens
  chr3:20139710-20139730
  Hypo
gacaacgtcccaaattaaaa

SEQ ID NO: 121830 - DNA, 225 bp, Homo sapiens; identical to SEQ ID NO: 90953
  chr3:21447375-21447600
  Hypo

SEQ ID NO: 121831 - DNA, 41 bp, Homo sapiens; identical to SEQ ID NO: 90954
  chr3:21973359-21973400
  Hypo

SEQ ID NO: 121832 - DNA, 22 bp, Homo sapiens
  chr3:22241703-22241725
  Hypo
tcctggcaagattatcggggaa

SEQ ID NO: 121833 - DNA, 91 bp, Homo sapiens; identical to SEQ ID NO: 39887
  chr3:22370592-22370683
  Hypo

SEQ ID NO: 121834 - DNA, 730 bp, Homo sapiens
  chr3:22413593-22414323
  Hyper
gaaccaggctgacctcgcccccccgcctcggcctcccctgccccttggttctcggcaatgagctgtgacctgagaccctccagctccgcgctcttcactctggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaaccgagacacctctttttgcactcaacttaccgcggctgggctgagctttcggcgcccccaggagcttttctctccttcctcccaccgagctcttcattctcctgctggcggccgcccggcgccctggccctggcatccgggaggagcagccgccggggctggctgtcccgggagacgcacggctgcccgcctgcagcttcaacggcggtggtcgccgcgagccgtgagcggcggccaaggagaacggtctccgttgcgcagcgcgtgctgtccctccggcacgggctggaggtggcagtcagcgcgcctctgcctccgccgcgctcgcggcgctccgcacgagtcccgagccggcgtcagcccaggtgcaccaggctggggagaggtgcgagcccgcgcgaagggaggggccc

SEQ ID NO: 121835 - DNA, 45 bp, Homo sapiens; identical to SEQ ID NO: 90960
  chr3:22587374-22587419
  Hypo

SEQ ID NO: 121836 - DNA, 30 bp, Homo sapiens; identical to SEQ ID NO: 90961
  chr3:23032111-23032141
  Hypo

SEQ ID NO: 121837 - DNA, 82 bp, Homo sapiens; identical to SEQ ID NO: 90962
  chr3:23111021-23111103
  Hypo

SEQ ID NO: 121838 - DNA, 30 bp, Homo sapiens; identical to SEQ ID NO: 90963
  chr3:23245806-23245836
  Hyper

SEQ ID NO: 121839 - DNA, 134 bp, Homo sapiens; identical to SEQ ID NO: 90964
  chr3:23726999-23727133
  Hypo

SEQ ID NO: 121840 - DNA, 141 bp, Homo sapiens; identical to SEQ ID NO: 90969
  chr3:24535454-24535595
  Hyper

SEQ ID NO: 121841 - DNA, 85 bp, Homo sapiens
  chr3:24535903-24535988
  Hyper
cagcctgccgccgcgcggtgcccgaacacgagagggcacctcctcccagatccggggcgcagaagccccgcggaggcaggtaatc

SEQ ID NO: 121842 - DNA, 118 bp, Homo sapiens; identical to SEQ ID NO: 90971
  chr3:24563619-24563737
  Hyper

SEQ ID NO: 121843 - DNA, 258 bp, Homo sapiens; identical to SEQ ID NO: 90972
  chr3:24870586-24870844
  Hyper

SEQ ID NO: 121844 - DNA, 123 bp, Homo sapiens
  chr3:24871069-24871192
  Hyper
ttggggggtctgcagcgggagcccgcgaccgatcccaggacatctggactcgcggacaactttgcgcagcagtcctcttccaagttccctttattgctattgtcttagcgcctgtctgacagt

SEQ ID NO: 121845 - DNA, 97 bp, Homo sapiens; identical to SEQ ID NO: 28100
  chr3:24871789-24871886
  Hyper

SEQ ID NO: 121846 - DNA, 156 bp, Homo sapiens; identical to SEQ ID NO: 28101
  chr3:24871946-24872102
  Hyper

SEQ ID NO: 121847 - DNA, 100 bp, Homo sapiens
  chr3:25469358-25469458
  Hyper
ggctggggggcgaggcggtgggcgggaggcgagcgggcgcaggcggaacaccgttttccaagctaagccgccgcaaataaaaaggcgtaaagggagagaa

SEQ ID NO: 121848 - DNA, 195 bp, Homo sapiens
  chr3:25469679-25469874
  Hyper
gaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcga

SEQ ID NO: 121849 - DNA, 1650 bp, Homo sapiens; identical to SEQ ID NO: 90980
  chr3:26664032-26665682
  Hyper

SEQ ID NO: 121850 - DNA, 474 bp, Homo sapiens
  chr3:27410605-27411079
  Hyper
tggctcccgaggcttcggggccgctccacagggacctgaggacgtctccccggagaccctgactcaagctgctcgccggcacagccgagcaccggctcccgcctactcaccgcgcgggagggacggtccctccttcaggccaatctccttatcattgtccctgctgctgtcacctgctgctgcagaccgggggtcccgtccagtctcagcccgtcccgtcctccccccagcctattcccggtcccctcaacctcagggacaccgcggccagctgcaccgttggttttccaatcaaatcctcctccaggccaccaaccagcgctggccaggccaatgccgacaattcttcctccgccacctggggcgcctcagccaatcgggagcagccatgctgcgcagtgcagaacgccatagcgacggatgacgcctgccggggaatcgccgtagcaaccagagacgcgctagatccaccac

SEQ ID NO: 121851 - DNA, 920 bp, Homo sapiens; identical to SEQ ID NO: 90983
  chr3:27754008-27754928
  Hyper

SEQ ID NO: 121852 - DNA, 155 bp, Homo sapiens; identical to SEQ ID NO: 90984
  chr3:27756087-27756242
  Hyper

SEQ ID NO: 121853 - DNA, 62 bp, Homo sapiens; identical to SEQ ID NO: 90985
  chr3:27756653-27756715
  Hyper

SEQ ID NO: 121854 - DNA, 1826 bp, Homo sapiens; identical to SEQ ID NO: 90986
  chr3:27762336-27764162
  Hyper

SEQ ID NO: 121855 - DNA, 267 bp, Homo sapiens
  chr3:27764407-27764674
  Hyper
ataatcaatcctggtgtctgtaatttcgccggaatttagggggacaaagtttggggtctccatagcggtgtccacccttggcgcattagtcatctcagccctccgctggaggaatgagatggctggagcagattttagaggccagagagagaaagactcttcaagctgatagcttgcagggaagcgcccgtcccggaggctggggaaactggggcaagttggagacaggcccaaggaagtctctttcctcgtcggaagctgtaactt

SEQ ID NO: 121856 - DNA, 644 bp, Homo sapiens
  chr3:27764898-27765542
  Hyper
aagagtgaaactaagcgagctaacaccaacttcatactcacgccaacacaactgctttcggggagacagtcacttttattccccacaatttaaaatcctttctgctcagttttcctgatcccggattccgtcccttcaccaccatcttcagttaggcctgacaccaagaaacaaagcttccctaacagccccacagttaggattccctgcgcctctgctctgcggcaaatacagaaggtagaataattagtgaaataatcagtttgatattgaattaaactccagctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttccggctgagatgtcgggactctgcttccccaaccgaacgcgatcacacgggaaactcttcgcccacaacagatgagatggccaaaggattgctgagtgcgcacacgcaagtgtagaacagtgcgaagctttccaacccagttttccaaccacagcagcaccaacatcggcatgtctggggt

SEQ ID NO: 121857 - DNA, 30 bp, Homo sapiens; identical to SEQ ID NO: 90991
  chr3:27765844-27765874
  Hyper

SEQ ID NO: 121858 - DNA, 580 bp, Homo sapiens; identical to SEQ ID NO: 90992
  chr3:27771471-27772051
  Hyper

SEQ ID NO: 121859 - DNA, 1321 bp, Homo sapiens
  chr3:28616662-28617983
  Hyper
acggcgcccagctggcgcccgccccgggcacattgcagtaaatgcctggcagcgacttctcgcttctccttcctcctaccccatcgaccctctgttgccgacctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttctagtcctcgccgccaccacctcgcacaggtcggagatccctcctttccttggctcctttgcgttggggagggggtaaggctgagggtcggcgcttggtcagcgggcggggaaggtagatttcacttgcacctgagagtccctattcttgccagcttcgccgggcaaagcccggcgaccaggttggttcttccagcaactttgttcagaaggttggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaagggagggcgcgcgggaggcggcccctcctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcgacgatcccgagacgagacccaacggcgagaaaggagagag

SEQ ID NO: 121860 - DNA, 127 bp, Homo sapiens; identical to SEQ ID NO: 90995
  chr3:28618197-28618324
  Hyper

SEQ ID NO: 121861 - DNA, 86 bp, Homo sapiens; identical to SEQ ID NO: 90997
  chr3:29322482-29322568
  Hyper

SEQ ID NO: 121862 - DNA, 139 bp, Homo sapiens; identical to SEQ ID NO: 91001
  chr3:32151266-32151405
  Hypo

SEQ ID NO: 121863 - DNA, 53 bp, Homo sapiens; identical to SEQ ID NO: 91002
  chr3:32433612-32433665
  Hyper

SEQ ID NO: 121864 - DNA, 203 bp, Homo sapiens; identical to SEQ ID NO: 91003
  chr3:32433865-32434068
  Hyper

SEQ ID NO: 121865 - DNA, 495 bp, Homo sapiens
  chr3:32443015-32443510
  Hyper
attccctgtgtgggccggtgtatttatttaaattcccgttgcagcgaaggccgcccttctgtcttcctgccagccctggcgcttcctgtgcagcgccactggacagccatctgtttcctcccctctgccatctgcctcgcgccgggcccagcgtgcggccctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgacttgtgtttaaatcagcaagggcagtgacgcggctcttccttttc

SEQ ID NO: 121866 - DNA, 2559 bp, Homo sapiens
  chr3:32857718-32860277
  Hyper
gagttctttaaaaaacgtaaaaagaaaaaaagaaaaggtgggtaaaaaccgagatctcccgggcagtggatatgtctcggttgagccagggattcagaatgaaatcttttcttttcttttttaaataaacggaagagtcgttctctgctcctcgctcagaaggtttcaaaggtcgtcacactgaagcccgggggcgttcatctccccagcggccgggagaagggaggaggttggagggcggagggagggagcacacaaaagcgggccgtgctgagagggctaatgtttcctgtttgcctggagccccctcccctgcctcccctcccccagccccctcccagcactcgggcggaagtgagtttgctcctttggagattaaaaggattccgaattccgatcagtcccaataaccggcgtactgaagagaagaggaggaggaggaggaggcagaggcggcaaagcagagaaagagggggcgcgcgcgcgcgcacgcaacccgaactgggggagttgtgcaaagccccaggaggccggggcacggcgggagcaaagctcggtaggcgcagcgcggccgaggccacccgcgtccggatcggcgactcctttcagaaagaagatgacgcgggcgcgagccggcggcgttggccacgcggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgcgtgcgtactgcacgcgtgcggccgcggctgggccaccacgagctgcagctgctgcggggcccaccgccctgcaggggaggccgtgcctggctgtgcgcaagccccaagcgcagcacgccgggccacccaggagcccctggccgccgcgtcatgcggcggggcagccgacgtcgcgcggggagacaccggcttggcgacgcaccgctcccgcctttactagtttggggctccttcccctcccaagaacagactaaatccgtttaaagaaaagcaacgcaccaaatactcgtggaaccaaattctgctctcgccgggactgggactgcacagcgaactctccttttgggaactcctttcgtctatcgcgaagggaagcctcagctgctccagggagtcttccgacctccctgcccccgctcgcccctcgcctgtcggggcttgttccggcgttccctcttcggaaggcacgcggcccccaagttatccggaggaatctgtgtcgccgctggatagtggcatttaatgcctgcagtgtcgggggtggcagcgctcgggccggacgtggcgaggccaagcgggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggac

SEQ ID NO: 121867 - DNA, 39 bp, Homo sapiens; identical to SEQ ID NO: 91009
  chr3:33136909-33136948
  Hypo

SEQ ID NO: 121868 - DNA, 1100 bp, Homo sapiens; identical to SEQ ID NO: 91010
  chr3:33259696-33260796
  Hyper

SEQ ID NO: 121869 - DNA, 235 bp, Homo sapiens; identical to SEQ ID NO: 91011
  chr3:33318803-33319038
  Hyper

SEQ ID NO: 121870 - DNA, 57 bp, Homo sapiens; identical to SEQ ID NO: 91012
  chr3:33319265-33319322
  Hyper

SEQ ID NO: 121871 - DNA, 270 bp, Homo sapiens; identical to SEQ ID NO: 91013
  chr3:33841087-33841357
  Hypo

SEQ ID NO: 121872 - DNA, 89 bp, Homo sapiens; identical to SEQ ID NO: 91014
  chr3:33841657-33841746
  Hypo

SEQ ID NO: 121873 - DNA, 29 bp, Homo sapiens
  chr3:34246970-34246999
  Hypo
aaacacctggctgggcgcggtgactcacg

SEQ ID NO: 121874 - DNA, 190 bp, Homo sapiens; identical to SEQ ID NO: 91016
  chr3:34690946-34691136
  Hypo

SEQ ID NO: 121875 - DNA, 126 bp, Homo sapiens; identical to SEQ ID NO: 91017
  chr3:35204511-35204637
  Hypo

SEQ ID NO: 121876 - DNA, 866 bp, Homo sapiens
  chr3:35680775-35681641
  Hyper
ggatgctcccagtggcgcagaggcggcgacactggcaggcgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgc

SEQ ID NO: 121877 - DNA, 194 bp, Homo sapiens; identical to SEQ ID NO: 91019
  chr3:35740310-35740504
  Hypo

SEQ ID NO: 121878 - DNA, 19 bp, Homo sapiens
  chr3:35866142-35866161
  Hypo
agaccggagctgttcctat

SEQ ID NO: 121879 - DNA, 23 bp, Homo sapiens
  chr3:36407036-36407059
  Hypo
cgagactccgtcccaaaaaaaaa

SEQ ID NO: 121880 - DNA, 30 bp, Homo sapiens; identical to SEQ ID NO: 28126
  chr3:36421872-36421902
  Hyper

SEQ ID NO: 121881 - DNA, 41 bp, Homo sapiens; identical to SEQ ID NO: 91023
  chr3:36422182-36422223
  Hyper

SEQ ID NO: 121882 - DNA, 29 bp, Homo sapiens
  chr3:36805450-36805479
  Hyper
caggtggtgtacacccgcacgcgcgcgcg

SEQ ID NO: 121883 - DNA, 688 bp, Homo sapiens
  chr3:36805539-36806227
  Hyper
tacacccacgcggggtctggcactgctgctacatcccgcacggagcggggtccagagttagggcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcgacggtcgagcaggcgcgggaaggcggggcgagacgagcagccacgagcccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccccggtcagcggagtccagcctttctgctctccttccccgcgcagttccgcggtggaacctggctgcgctgggttttgaacgtgcgctttgcccctgtt

SEQ ID NO: 121884 - DNA, 602 bp, Homo sapiens; identical to SEQ ID NO: 91027
  chr3:36985811-36986413
  Hyper

SEQ ID NO: 121885 - DNA, 57 bp, Homo sapiens; identical to SEQ ID NO: 28130
  chr3:36986663-36986720
  Hyper

SEQ ID NO: 121886 - DNA, 17 bp, Homo sapiens
  chr3:37296942-37296959
  Hypo
cacgcctgacctttata

SEQ ID NO: 121887 - DNA, 898 bp, Homo sapiens
  chr3:37493519-37494417
  Hyper
acggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgct

SEQ ID NO: 121888 - DNA, 43 bp, Homo sapiens; identical to SEQ ID NO: 91031
  chr3:37876198-37876241
  Hypo

SEQ ID NO: 121889 - DNA, 49 bp, Homo sapiens; identical to SEQ ID NO: 91032
  chr3:37902046-37902095
  Hyper

SEQ ID NO: 121890 - DNA, 66 bp, Homo sapiens; identical to SEQ ID NO: 91033
  chr3:37902518-37902584
  Hyper

SEQ ID NO: 121891 - DNA, 30 bp, Homo sapiens; identical to SEQ ID NO: 91034
  chr3:38030684-38030714
  Hypo

SEQ ID NO: 121892 - DNA, 372 bp, Homo sapiens; identical to SEQ ID NO: 91035
  chr3:38032099-38032471
  Hypo

SEQ ID NO: 121893 - DNA, 448 bp, Homo sapiens
  chr3:38035626-38036074
  Hyper
ccacttcctgatctccgcggaagcccctgcctagcgtctccccatggcccttggtacatcctccccttctccacccgcacctccgtcttccccgcaacacatatacacaaacacccggaccctaggtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatgtgagtgcgggggcgaccggggcaggagggagccgtggaggcggtgccttggctggggcagtcttgggatggccatcgtccacatccctgaatggggcaagccgggaggggttgggt

SEQ ID NO: 121894 - DNA, 50 bp, Homo sapiens; identical to SEQ ID NO: 91037
  chr3:38041092-38041142
  Hypo

SEQ ID NO: 121895 - DNA, 871 bp, Homo sapiens
  chr3:38070703-38071574
  Hyper
caggacaagggggtccgcgaggcggagggaagtctttagacccgtaccgcccgcccacccaccccccgggctagatctcggacaagcctggaaacgcccagggtcgtgcccggcagtcccacccagggagccgcgggctgagattttcccagtccggagaaggggcagagaggcgggcccggggtggtgtggaggcggccgaaggagctgggggctccctgtccagggcccggaacagctttccaggggtccacccctgcagggtctcccgctcgcgcgggccaggcactcaccgtgcagggtcaggaagtcccggcccgagtccatgcccgacgggcggcgcggcgggaggggcaccgcgggactcacttgagtagcgacagcaccggcggcctggggtccgagcggagtgcggtgcagggacctgaatggaccgcggtgggaggaggccgggggtggtcccgggacaccgccccgcccccgctgccctgcgcccccgccccctgagcccgccaaccctcgtctctccccgcccccttctggggacgcgagagggagggcagagctgggggcccggaggactggccaaccctggcccgggccagcgggcgcgccccgaccagaaatagccagattcctccagcttcctccgccgccgccacccacgggccgcgggccctgtcattaccgcgggcggccgggccccacgccctgttgtgggcgcctcgctggggtcggggtgatgctggaaagaatccggcgtcatcccggggaagggatcgtgtaaggtccgacgcccagccgggctgctgcgctagggagacgcggcgtccaggcttccagccgcagctcccagcgttcgcattccctt

SEQ ID NO: 121896 - DNA, 734 bp, Homo sapiens
  chr3:38080619-38081353
  Hyper
tgaccacagcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcaggtaacgtggcggtggcgtcgcgtctgcggacggtgccggggtctcagcgctcggcacgcgtcagcacctgccaggtgccaggcgctgttccaggatctggggctgcagttgagaaacagcccatcatgccgaagtgggcccgacattctagtggaaggacgctctatccatacacacacatgcgcaaataccacacataccacacaacgtgcggcatatatctgta

SEQ ID NO: 121897 - DNA, 20 bp, Homo sapiens
  chr3:38207993-38208013
  Hypo
gtaagaagggctgggcgtgg

SEQ ID NO: 121898 - DNA, 30 bp, Homo sapiens; identical to SEQ ID NO: 91043
  chr3:38350133-38350163
  Hypo

SEQ ID NO: 121899 - DNA, 147 bp, Homo sapiens; identical to SEQ ID NO: 39897
  chr3:38627339-38627486
  Hypo

SEQ ID NO: 121900 - DNA, 169 bp, Homo sapiens; identical to SEQ ID NO: 91046
  chr3:38631185-38631354
  Hypo

SEQ ID NO: 121901 - DNA, 30 bp, Homo sapiens; identical to SEQ ID NO: 91047
  chr3:38640456-38640486
  Hypo

SEQ ID NO: 121902 - DNA, 319 bp, Homo sapiens; identical to SEQ ID NO: 91048
  chr3:38690443-38690762
  Hyper

SEQ ID NO: 121903 - DNA, 55 bp, Homo sapiens; identical to SEQ ID NO: 91049
  chr3:38691089-38691144
  Hyper

SEQ ID NO: 121904 - DNA, 122 bp, Homo sapiens
  chr3:38691404-38691526
  Hyper
acagccacagacagccgcacacgcggccgcggacagacagacataggcgggggtacacacacggcgacccggcgacgcttcaccacagatggccacccacgcggacgcggacaggctcacat

SEQ ID NO: 121905 - DNA, 30 bp, Homo sapiens; identical to SEQ ID NO: 39898
  chr3:38950258-38950288
  Hypo

SEQ ID NO: 121906 - DNA, 33 bp, Homo sapiens; identical to SEQ ID NO: 91052
  chr3:39167780-39167813
  Hypo

SEQ ID NO: 121907 - DNA, 42 bp, Homo sapiens; identical to SEQ ID NO: 91053
  chr3:39850324-39850366
  Hyper

SEQ ID NO: 121908 - DNA, 792 bp, Homo sapiens; identical to SEQ ID NO: 91054
  chr3:39851235-39852027
  Hyper

SEQ ID NO: 121909 - DNA, 40 bp, Homo sapiens; identical to SEQ ID NO: 91055
  chr3:40501052-40501092
  Hypo

SEQ ID NO: 121910 - DNA, 52 bp, Homo sapiens; identical to SEQ ID NO: 39900
  chr3:41289147-41289199
  Hypo

SEQ ID NO: 121911 - DNA, 30 bp, Homo sapiens; identical to SEQ ID NO: 91058
  chr3:42056206-42056236
  Hyper

SEQ ID NO: 121912 - DNA, 20 bp, Homo sapiens
  chr3:42162758-42162778
  Hypo
tttttttttttgagacggag

SEQ ID NO: 121913 - DNA, 149 bp, Homo sapiens; identical to SEQ ID NO: 39901
  chr3:42200630-42200779
  Hypo

SEQ ID NO: 121914 - DNA, 18 bp, Homo sapiens
  chr3:42222719-42222737
  Hypo
ttgcattgaaatgtgcgt

SEQ ID NO: 121915 - DNA, 438 bp, Homo sapiens; identical to SEQ ID NO: 91062
  chr3:42304950-42305388
  Hyper

SEQ ID NO: 121916 - DNA, 553 bp, Homo sapiens; identical to SEQ ID NO: 91063
  chr3:42543027-42543580
  Hyper

SEQ ID NO: 121917 - DNA, 44 bp, Homo sapiens; identical to SEQ ID NO: 91064
  chr3:42631036-42631080
  Hypo

SEQ ID NO: 121918 - DNA, 120 bp, Homo sapiens; identical to SEQ ID NO: 91065
  chr3:42640754-42640874
  Hypo

SEQ ID NO: 121919 - DNA, 29 bp, Homo sapiens
  chr3:42696559-42696588
  Hyper
gattcgggatgacccgggccaagggggtg

SEQ ID NO: 121920 - DNA, 860 bp, Homo sapiens; identical to SEQ ID NO: 28144
  chr3:42814258-42815118
  Hyper

SEQ ID NO: 121921 - DNA, 108 bp, Homo sapiens; identical to SEQ ID NO: 91067
  chr3:42850925-42851033
  Hypo

SEQ ID NO: 121922 - DNA, 592 bp, Homo sapiens
  chr3:42947369-42947961
  Hyper
gtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggtgtggagcacggggagtcgggcgtggggcgggcagggagtggagtcggggtcttactccggtggctgcagggcgcagggtagccgtgtcaggcctgcccaggtgcagagcgctcttccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggtgagtgcggggccggagcctggaagca

SEQ ID NO: 121923 - DNA, 575 bp, Homo sapiens; identical to SEQ ID NO: 91070
  chr3:43020896-43021471
  Hyper

SEQ ID NO: 121924 - DNA, 326 bp, Homo sapiens; identical to SEQ ID NO: 91071
  chr3:43147281-43147607
  Hyper

SEQ ID NO: 121925 - DNA, 38 bp, Homo sapiens; identical to SEQ ID NO: 91072
  chr3:43633110-43633148
  Hypo

SEQ ID NO: 121926 - DNA, 30 bp, Homo sapiens; identical to SEQ ID NO: 91073
  chr3:43655462-43655492
  Hypo

SEQ ID NO: 121927 - DNA, 30 bp, Homo sapiens; identical to SEQ ID NO: 91074
  chr3:43664372-43664402
  Hypo

SEQ ID NO: 121928 - DNA, 29 bp, Homo sapiens
  chr3:43664642-43664671
  Hypo
ccaccgcgccctgccggctttaagtgttt

SEQ ID NO: 121929 - DNA, 32 bp, Homo sapiens; identical to SEQ ID NO: 91076
  chr3:43749395-43749427
  Hypo

SEQ ID NO: 121930 - DNA, 204 bp, Homo sapiens; identical to SEQ ID NO: 91077
  chr3:43828321-43828525
  Hypo

SEQ ID NO: 121931 - DNA, 385 bp, Homo sapiens; identical to SEQ ID NO: 91078
  chr3:43935797-43936182
  Hyper

SEQ ID NO: 121932 - DNA, 2754 bp, Homo sapiens
  chr3:44036168-44038922
  Hyper
tcactttgctgtcagcgacgtgatgtgctctgcagtgctggaattgagagttcaagagagagataccggtcctggcctctcggtgttcaggtgtgtgtataggtgggcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgcgggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagacctagaaatgaaaacgtacccacctttct

SEQ ID NO: 121933 - DNA, 1793 bp, Homo sapiens
  chr3:44039357-44041150
  Hyper
gagggacgtgttgcccgactggtctaaataaggaaagaaagtggagtaccaaagaatcaagggcctctgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcaccacgataacggccctctccccttccacccggccggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcgagtccgtgcgatgcccaggtcaagtttgcagagagagtctgcggtgtctgtctcct

SEQ ID NO: 121934 - DNA, 830 bp, Homo sapiens; identical to SEQ ID NO: 91083
  chr3:44063273-44064103
  Hyper

SEQ ID NO: 121935 - DNA, 236 bp, Homo sapiens; identical to SEQ ID NO: 91084
  chr3:44481308-44481544
  Hyper

SEQ ID NO: 121936 - DNA, 567 bp, Homo sapiens; identical to SEQ ID NO: 28155
  chr3:44596464-44597031
  Hyper

SEQ ID NO: 121937 - DNA, 398 bp, Homo sapiens
  chr3:44626341-44626739
  Hyper
ggggcttctgaggggcggggggactccagcccgcgggcacagagatgtggaaacctcacgaagcctagaagggccggagggacaggctgggagttagctgggagttgctgacgcagttccttctgcgctttgttcaagatgtgggtctggcgctttcggtgaggggtgctctacagtctggcgtggggggtcgggccgggttctgggagcgtgtgggagacgcaagccaggaggccagggctcctctgcggctgcccgctgctgagatgggcgcggcagccaaggggtcgttgtgggcctcccctttctctcgttcagtgctgcccctttgtcttgggtccagtctctgactcctcgtagctgctcgcttggaccaggctggccgtggtgacagcact

SEQ ID NO: 121938 - DNA, 30 bp, Homo sapiens; identical to SEQ ID NO: 91088
  chr3:44690145-44690175
  Hyper

SEQ ID NO: 121939 - DNA, 59 bp, Homo sapiens; identical to SEQ ID NO: 91089
  chr3:44690430-44690489
  Hyper

SEQ ID NO: 121940 - DNA, 404 bp, Homo sapiens
  chr3:44726846-44727250
  Hyper
ggtataaatatgaccgcaaaactgcccttcaagcagttgacgagcgactttccccttacatcaagtgcacagtaagcccaagcgccggggccgcggggattcccgccagtcactcccgccactaccgccacccggccccgccgccagcgcagcccgcagccccggcaagcctgcgcccgctcggccccggtctctttcgctcaccagaggctacggggcgcccggccccgcacacccaagaaacactgccaccgcgacgcgcctgcccccaggatcctctcgcgagcttcagtacccaaggaagatgggccgtcccggaagtgcggccggggcgacttgcaggcccctcgccgaccgctctaggaatctcggaggtcttttgacctcgacgcctccttacctgg

SEQ ID NO: 121941 - DNA, 30 bp, Homo sapiens; identical to SEQ ID NO: 91092
  chr3:44750897-44750927
  Hypo

SEQ ID NO: 121942 - DNA, 38 bp, Homo sapiens; identical to SEQ ID NO: 91093
  chr3:44754084-44754122
  Hyper

SEQ ID NO: 121943 - DNA, 71 bp, Homo sapiens; identical to SEQ ID NO: 91094
  chr3:44754341-44754412
  Hyper

SEQ ID NO: 121944 - DNA, 172 bp, Homo sapiens; identical to SEQ ID NO: 91095
  chr3:44770921-44771093
  Hyper

SEQ ID NO: 121945 - DNA, 102 bp, Homo sapiens; identical to SEQ ID NO: 91096
  chr3:44938757-44938859
  Hypo

SEQ ID NO: 121946 - DNA, 34 bp, Homo sapiens; identical to SEQ ID NO: 39907
  chr3:44999995-45000029
  Hypo

SEQ ID NO: 121947 - DNA, 30 bp, Homo sapiens; identical to SEQ ID NO: 91098
  chr3:45153808-45153838
  Hypo

SEQ ID NO: 121948 - DNA, 90 bp, Homo sapiens
  chr3:45187296-45187386
  Hyper
tgctttcaagaatcccggcaaagaccctggggcgcacggcgcgccaccttggacatgtcgcctgggatcggctaccgggagctccttttc

SEQ ID NO: 121949 - DNA, 96 bp, Homo sapiens; identical to SEQ ID NO: 91100
  chr3:45266369-45266465
  Hyper

SEQ ID NO: 121950 - DNA, 30 bp, Homo sapiens; identical to SEQ ID NO: 39908
  chr3:45821641-45821671
  Hypo

SEQ ID NO: 121951 - DNA, 751 bp, Homo sapiens; identical to SEQ ID NO: 91102
  chr3:45837489-45838240
  Hyper

SEQ ID NO: 121952 - DNA, 30 bp, Homo sapiens; identical to SEQ ID NO: 14530
  chr3:45885052-45885082
  Hypo

SEQ ID NO: 121953 - DNA, 30 bp, Homo sapiens; identical to SEQ ID NO: 91104
  chr3:46009746-46009776
  Hypo

SEQ ID NO: 121954 - DNA, 30 bp, Homo sapiens; identical to SEQ ID NO: 91105
  chr3:46245355-46245385
  Hypo

SEQ ID NO: 121955 - DNA, 30 bp, Homo sapiens; identical to SEQ ID NO: 91106
  chr3:46464272-46464302
  Hypo

SEQ ID NO: 121956 - DNA, 30 bp, Homo sapiens; identical to SEQ ID NO: 91107
  chr3:46480817-46480847
  Hypo

SEQ ID NO: 121957 - DNA, 23 bp, Homo sapiens
  chr3:46584785-46584808
  Hypo
ttccctttaccataccgggcaca

SEQ ID NO: 121958 - DNA, 38 bp, Homo sapiens; identical to SEQ ID NO: 91109
  chr3:46586155-46586193
  Hypo

SEQ ID NO: 121959 - DNA, 39 bp, Homo sapiens; identical to SEQ ID NO: 91110
  chr3:46592147-46592186
  Hypo

SEQ ID NO: 121960 - DNA, 49 bp, Homo sapiens; identical to SEQ ID NO: 91111
  chr3:46607725-46607774
  Hyper

SEQ ID NO: 121961 - DNA, 58 bp, Homo sapiens; identical to SEQ ID NO: 91112
  chr3:46853945-46854003
  Hyper

SEQ ID NO: 121962 - DNA, 1399 bp, Homo sapiens; identical to SEQ ID NO: 91113
  chr3:46922878-46924277
  Hyper

SEQ ID NO: 121963 - DNA, 250 bp, Homo sapiens; identical to SEQ ID NO: 91114
  chr3:46924989-46925239
  Hyper

SEQ ID NO: 121964 - DNA, 40 bp, Homo sapiens; identical to SEQ ID NO: 91115
  chr3:46934058-46934098
  Hyper

SEQ ID NO: 121965 - DNA, 230 bp, Homo sapiens; identical to SEQ ID NO: 91116
  chr3:46948863-46949093
  Hypo

SEQ ID NO: 121966 - DNA, 30 bp, Homo sapiens; identical to SEQ ID NO: 91118
  chr3:46985725-46985755
  Hypo

SEQ ID NO: 121967 - DNA, 22 bp, Homo sapiens
  chr3:47018686-47018708
  Hypo
gggcgcggtggctcacgcctgt

SEQ ID NO: 121968 - DNA, 20 bp, Homo sapiens
  chr3:47020175-47020195
  Hypo
tctgtaaaacagagccggcc

SEQ ID NO: 121969 - DNA, 20 bp, Homo sapiens
  chr3:47521018-47521038
  Hypo
gggcgcggtggctcacgcct

SEQ ID NO: 121970 - DNA, 22 bp, Homo sapiens
  chr3:47555871-47555893
  Hypo
gccgacacggaattatatcttg

SEQ ID NO: 121971 - DNA, 41 bp, Homo sapiens; identical to SEQ ID NO: 91124
  chr3:47588423-47588464
  Hypo

SEQ ID NO: 121972 - DNA, 38 bp, Homo sapiens; identical to SEQ ID NO: 91125
  chr3:47843707-47843745
  Hypo

SEQ ID NO: 121973 - DNA, 37 bp, Homo sapiens; identical to SEQ ID NO: 91126
  chr3:47845756-47845793
  Hypo

SEQ ID NO: 121974 - DNA, 40 bp, Homo sapiens; identical to SEQ ID NO: 91128
  chr3:48227765-48227805
  Hypo

SEQ ID NO: 121975 - DNA, 77 bp, Homo sapiens; identical to SEQ ID NO: 91129
  chr3:48236476-48236553
  Hypo

SEQ ID NO: 121976 - DNA, 459 bp, Homo sapiens; identical to SEQ ID NO: 39915
  chr3:48636676-48637135
  Hypo

SEQ ID NO: 121977 - DNA, 118 bp, Homo sapiens; identical to SEQ ID NO: 91131
  chr3:48689342-48689460
  Hypo

SEQ ID NO: 121978 - DNA, 973 bp, Homo sapiens
  chr3:48693262-48694235
  Hyper
gctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcagcgaaagccgccgttgggcgcgtcggtgcaggtgcccccgttgcggcagacgcccggcacgcagcggccggcctcggtgtccagctcgcagtcctctcctgggggccaagccgcggtcagaggcggtcacgcccacgcccgcccctgctccggccccttcaaagaccgcgcgcccagaggccgggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgcacgtgtagcctccctcgcgccgcgcgcaggctccgccgttgcgacatgggttggagtagcagaggtcgagctcggtctcgc

SEQ ID NO: 121979 - DNA, 1882 bp, Homo sapiens
  chr3:48698801-48700683
  Hyper
tgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtccgggtcctgagcaaccacgcgtagcaccgcggtgcctgctgcctcattctccggcaccagcgtctggtagttgtactgcggaaactgcgggtggcggtttgcggcgcgacgaaagcgtgcccggttcgccgaggttactttcctggcttcaggacgggccgggagtcccgggggacgcggcccggggcgctgcgggaggaagcggcagcggaagagaccccgggagcgcatgcgcttgggcgccggctcgggagctgtccgagactcgcggggtgctgaacctgatgcaggagctgtcctcgccgtgcgtggtgctgaatccagctcggggccagatcccgaggcccctggaagacagttccgccggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgccatctttattgaggacgtgagcgttgctcctggtgctgaacagagcgcgaaggttcgccgtcgttgggtccgccctccccactttcggtcgccgccttcacccacctccctccttctagggcgctgtcccagctccgtctcccagcctttttctgtccttccagatctcttgttcccccttcctgaccactagttctgaaccgtgtcccggattttggtctgaaattttggtgcccatgagcgttctcatagctct

SEQ ID NO: 121980 - DNA, 46 bp, Homo sapiens; identical to SEQ ID NO: 91138
  chr3:48701213-48701259
  Hyper

SEQ ID NO: 121981 - DNA, 105 bp, Homo sapiens; identical to SEQ ID NO: 91139
  chr3:48701471-48701576
  Hyper

SEQ ID NO: 121982 - DNA, 18 bp, Homo sapiens
  chr3:48884018-48884036
  Hypo
aagcgatatttcctcctc

SEQ ID NO: 121983 - DNA, 99 bp, Homo sapiens; identical to SEQ ID NO: 91141
  chr3:48948428-48948527
  Hypo

SEQ ID NO: 121984 - DNA, 111 bp, Homo sapiens; identical to SEQ ID NO: 91142
  chr3:49034204-49034315
  Hypo

SEQ ID NO: 121985 - DNA, 26 bp, Homo sapiens
  chr3:49056918-49056944
  Hypo
tttttttttttgagacggagtttcgc

SEQ ID NO: 121986 - DNA, 146 bp, Homo sapiens; identical to SEQ ID NO: 91144
  chr3:49057184-49057330
  Hypo

SEQ ID NO: 121987 - DNA, 30 bp, Homo sapiens; identical to SEQ ID NO: 39921
  chr3:49140985-49141015
  Hypo

SEQ ID NO: 121988 - DNA, 31 bp, Homo sapiens; identical to SEQ ID NO: 91147
  chr3:49189534-49189565
  Hypo

SEQ ID NO: 121989 - DNA, 30 bp, Homo sapiens; identical to SEQ ID NO: 91148
  chr3:49540372-49540402
  Hypo

SEQ ID NO: 121990 - DNA, 73 bp, Homo sapiens; identical to SEQ ID NO: 91149
  chr3:49592444-49592517
  Hyper

SEQ ID NO: 121991 - DNA, 54 bp, Homo sapiens; identical to SEQ ID NO: 91150
  chr3:49722997-49723051
  Hypo

SEQ ID NO: 121992 - DNA, 58 bp, Homo sapiens; identical to SEQ ID NO: 91151
  chr3:49755535-49755593
  Hypo

SEQ ID NO: 121993 - DNA, 45 bp, Homo sapiens; identical to SEQ ID NO: 91152
  chr3:49756360-49756405
  Hyper

SEQ ID NO: 121994 - DNA, 216 bp, Homo sapiens; identical to SEQ ID NO: 91153
  chr3:49851237-49851453
  Hyper

SEQ ID NO: 121995 - DNA, 409 bp, Homo sapiens; identical to SEQ ID NO: 91154
  chr3:49906970-49907379
  Hyper

SEQ ID NO: 121996 - DNA, 33 bp, Homo sapiens; identical to SEQ ID NO: 91155
  chr3:49920459-49920492
  Hypo

SEQ ID NO: 121997 - DNA, 907 bp, Homo sapiens; identical to SEQ ID NO: 91157
  chr3:49939687-49940594
  Hypo

SEQ ID NO: 121998 - DNA, 146 bp, Homo sapiens; identical to SEQ ID NO: 91158
  chr3:49941293-49941439
  Hyper

SEQ ID NO: 121999 - DNA, 94 bp, Homo sapiens; identical to SEQ ID NO: 91160
  chr3:50232113-50232207
  Hyper

SEQ ID NO: 122000 - DNA, 848 bp, Homo sapiens; identical to SEQ ID NO: 91161
  chr3:50242714-50243562
  Hyper

SEQ ID NO: 122001 - DNA, 29 bp, Homo sapiens
  chr3:50374655-50374684
  Hyper
tcgagctccgagtccgagtcctcttggct

SEQ ID NO: 122002 - DNA, 29 bp, Homo sapiens
  chr3:50374917-50374946
  Hyper
tggggcaggaacgccggggcggggacacg

SEQ ID NO: 122003 - DNA, 388 bp, Homo sapiens
  chr3:50375179-50375567
  Hyper
cctcccagcccccgcgcagaattagcctctctgtgccgccgggaaatcggcaattagaacgctccttgcgcgcggcacccaggcagccctcgagaatgcctgcactgtggcctgcccatcctcgcccttcccatacgccctcggccccgcgctcaccacgttcgtgtcccgctccaccgcgggttcccagcccaggtcccggggcccgcaacagtccaggcagacgagcgcgcggcagcggtagtggcaggtgaacttgcaatctgcagagaggcctggcggtgaggcggaggagctccaggtcggggaaatgtcccggagattgaagggaagccccagggagagggccgctgctcgccaggctccgcaggcccgacctatctcagtg

SEQ ID NO: 122004 - DNA, 30 bp, Homo sapiens; identical to SEQ ID NO: 14538
  chr3:50395506-50395536
  Hypo

SEQ ID NO: 122005 - DNA, 923 bp, Homo sapiens; identical to SEQ ID NO: 91164
  chr3:50402120-50403043
  Hyper

SEQ ID NO: 122006 - DNA, 75 bp, Homo sapiens; identical to SEQ ID NO: 91165
  chr3:50416271-50416346
  Hypo

SEQ ID NO: 122007 - DNA, 385 bp, Homo sapiens; identical to SEQ ID NO: 91166
  chr3:50425370-50425755
  Hypo

SEQ ID NO: 122008 - DNA, 111 bp, Homo sapiens; identical to SEQ ID NO: 91167
  chr3:50426562-50426673
  Hypo

SEQ ID NO: 122009 - DNA, 192 bp, Homo sapiens; identical to SEQ ID NO: 39928
  chr3:50433950-50434142
  Hypo

SEQ ID NO: 122010 - DNA, 30 bp, Homo sapiens; identical to SEQ ID NO: 91169
  chr3:50472586-50472616
  Hypo

SEQ ID NO: 122011 - DNA, 398 bp, Homo sapiens; identical to SEQ ID NO: 91170
  chr3:50540230-50540628
  Hyper

SEQ ID NO: 122012 - DNA, 56 bp, Homo sapiens; identical to SEQ ID NO: 91171
  chr3:50567928-50567984
  Hyper

SEQ ID NO: 122013 - DNA, 33 bp, Homo sapiens; identical to SEQ ID NO: 91172
  chr3:50575602-50575635
  Hypo

SEQ ID NO: 122014 - DNA, 451 bp, Homo sapiens; identical to SEQ ID NO: 91173
  chr3:50604981-50605432
  Hyper

SEQ ID NO: 122015 - DNA, 291 bp, Homo sapiens; identical to SEQ ID NO: 91174
  chr3:50712086-50712377
  Hyper

SEQ ID NO: 122016 - DNA, 25 bp, Homo sapiens
  chr3:50953960-50953985
  Hypo
tgtcttggccaggcacggtggctca

SEQ ID NO: 122017 - DNA, 511 bp, Homo sapiens
  chr3:51989989-51990500
  Hyper
gcacttggcctggcacgctaccgcctcatcgtgcacccgctgcggccaggctcgcggccgccgcctgtgctcgtgctcaccgccgtgtgggccgcggcgggactgctgggcgcgctctccctgctcggcacgccgcccgcaccgccccctgctcctgctcgctgctcggtcctggctgggggcctcgggcccttccggccgctctgggccctgctggccttcgcgctgcccgccctcctgctgctcggcgcctacggcggcatcttcgtggtggcgcgtcgcgctgccctgaggcccccacggccggcgcgcgggtcccgactccactcggactctctggatagccgcctttccatcttgccgccgctccggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctggg

SEQ ID NO: 122018 - DNA, 30 bp, Homo sapiens; identical to SEQ ID NO: 91179
  chr3:52009663-52009693
  Hyper

SEQ ID NO: 122019 - DNA, 30 bp, Homo sapiens; identical to SEQ ID NO: 91180
  chr3:52117389-52117419
  Hypo

SEQ ID NO: 122020 - DNA, 28 bp, Homo sapiens
  chr3:52352343-52352371
  Hypo
gagccactgcgcccggcctggaggtgca

SEQ ID NO: 122021 - DNA, 149 bp, Homo sapiens; identical to SEQ ID NO: 91182
  chr3:52415830-52415979
  Hypo

SEQ ID NO: 122022 - DNA, 30 bp, Homo sapiens; identical to SEQ ID NO: 39932
  chr3:52429714-52429744
  Hypo

SEQ ID NO: 122023 - DNA, 30 bp, Homo sapiens; identical to SEQ ID NO: 39933
  chr3:52537738-52537768
  Hypo

SEQ ID NO: 122024 - DNA, 30 bp, Homo sapiens; identical to SEQ ID NO: 91185
  chr3:52539389-52539419
  Hypo

SEQ ID NO: 122025 - DNA, 52 bp, Homo sapiens; identical to SEQ ID NO: 91186
  chr3:52548283-52548335
  Hypo

SEQ ID NO: 122026 - DNA, 84 bp, Homo sapiens; identical to SEQ ID NO: 14542
  chr3:52552577-52552661
  Hypo

SEQ ID NO: 122027 - DNA, 240 bp, Homo sapiens; identical to SEQ ID NO: 14543
  chr3:52553207-52553447
  Hypo

SEQ ID NO: 122028 - DNA, 70 bp, Homo sapiens; identical to SEQ ID NO: 91189
  chr3:52558829-52558899
  Hypo

SEQ ID NO: 122029 - DNA, 38 bp, Homo sapiens; identical to SEQ ID NO: 91190
  chr3:52568630-52568668
  Hypo

SEQ ID NO: 122030 - DNA, 37 bp, Homo sapiens; identical to SEQ ID NO: 91191
  chr3:52569926-52569963
  Hypo

SEQ ID NO: 122031 - DNA, 30 bp, Homo sapiens; identical to SEQ ID NO: 39936
  chr3:52599737-52599767
  Hypo

SEQ ID NO: 122032 - DNA, 30 bp, Homo sapiens; identical to SEQ ID NO: 91193
  chr3:52900469-52900499
  Hypo

SEQ ID NO: 122033 - DNA, 135 bp, Homo sapiens; identical to SEQ ID NO: 39937
  chr3:52900714-52900849
  Hypo

SEQ ID NO: 122034 - DNA, 31 bp, Homo sapiens; identical to SEQ ID NO: 39938
  chr3:53032137-53032168
  Hypo

SEQ ID NO: 122035 - DNA, 837 bp, Homo sapiens; identical to SEQ ID NO: 39939
  chr3:53032798-53033635
  Hypo

SEQ ID NO: 122036 - DNA, 30 bp, Homo sapiens; identical to SEQ ID NO: 39940
  chr3:53217535-53217565
  Hypo

SEQ ID NO: 122037 - DNA, 120 bp, Homo sapiens; identical to SEQ ID NO: 91198
  chr3:53879666-53879786
  Hyper

SEQ ID NO: 122038 - DNA, 30 bp, Homo sapiens; identical to SEQ ID NO: 91199
  chr3:53880694-53880724
  Hyper

SEQ ID NO: 122039 - DNA, 53 bp, Homo sapiens; identical to SEQ ID NO: 91200
  chr3:54121997-54122050
  Hyper

SEQ ID NO: 122040 - DNA, 267 bp, Homo sapiens; identical to SEQ ID NO: 91201
  chr3:54154739-54155006
  Hyper

SEQ ID NO: 122041 - DNA, 931 bp, Homo sapiens
  chr3:54155224-54156155
  Hyper
cccaggtgtctggtgcgccgggagccccggcgacgttaggagcgcactccttgctggggtcaccggagttgcgcttggccgggcaaggatgactcagcctcactccggtcggtctttaccgccagcctgcgcgagggctccacaaagttcccaatcacaccccatacctcgcacgggggagaggggttctgcaagctgggtcccggggtgggggcagcggcgagagaggcggggagaagcctggttcccagaacgcgcaggggcttctccggcttcctttctcctcgcccctgagggcggcgagaaggcgcctcctccggcgctcactgcctcctgcccagtgcggtgggcgccggagtggggagcaggcaatcccccaggctcggagaaatcttttatcccgaaatccagggtgtcccccggtcaggatcgactcggcgccgcgttggcttcctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcgcgccccctttaggttccgcggcccccgaccccgcccggcccaggggcggagcgggcatgctacgccctctcctagca

SEQ ID NO: 122042 - DNA, 718 bp, Homo sapiens
  chr3:54156356-54157074
  Hyper
gagtttccgagtccccgcccgcgcggcgcctcctgccccgccgccctcccgccgcggcccgccggactccccggggccgccgaggcggggccgggcggctgctgctgctagaggcgcgtctcgctgcctcctcccccgcccgcctccctccccacctctcctccctccctccccacctctcctccctccctctcctctccgccctccccgccccccccacccgctcctttttctgctccccaagtgagccgggcgcgcgagaggcaggcggggcggcgcggagcggagcaggcagccccgcgcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtgtaagtgccggctcctgcgccgcccggggaggggaccttgccgcctgcgacccactgtgcccaagtttgggcgcctgcaggtgcggctgggcaggacccgccgcgggcgtcggcctcgccgctcgcacctgcctttcgggacccgcgtcgggcggcgaggccggggtgggatgctctggcccctgcccgcaggttgccgagtgagatctgga

SEQ ID NO: 122043 - DNA, 606 bp, Homo sapiens; identical to SEQ ID NO: 91206
  chr3:54157313-54157919
  Hyper

SEQ ID NO: 122044 - DNA, 67 bp, Homo sapiens; identical to SEQ ID NO: 91209
  chr3:55519074-55519141
  Hyper

SEQ ID NO: 122045 - DNA, 107 bp, Homo sapiens; identical to SEQ ID NO: 91210
  chr3:55519516-55519623
  Hyper

SEQ ID NO: 122046 - DNA, 1065 bp, Homo sapiens; identical to SEQ ID NO: 91211
  chr3:55520325-55521390
  Hyper

SEQ ID NO: 122047 - DNA, 621 bp, Homo sapiens; identical to SEQ ID NO: 91212
  chr3:55521736-55522357
  Hyper

SEQ ID NO: 122048 - DNA, 695 bp, Homo sapiens; identical to SEQ ID NO: 28195
  chr3:55522595-55523290
  Hyper

SEQ ID NO: 122049 - DNA, 28 bp, Homo sapiens
  chr3:55573369-55573397
  Hypo
ggagattttctaagacgtattttctttt

SEQ ID NO: 122050 - DNA, 30 bp, Homo sapiens; identical to SEQ ID NO: 91215
  chr3:55577421-55577451
  Hypo

SEQ ID NO: 122051 - DNA, 203 bp, Homo sapiens; identical to SEQ ID NO: 91216
  chr3:56500452-56500655
  Hypo

SEQ ID NO: 122052 - DNA, 1123 bp, Homo sapiens
  chr3:56501705-56502828
  Hyper
tcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagcaggagcgggaggcggaggaagaggaggagaagcggggcggggaacagggagggaggaaagaagggaaggaggaggacactgctcggagggccagggccaggcgcggggccgggcggggccggcggccgagggggcggcacccgccgcagtcccgagacgcgcgctcgcgcggcgctgccaggcgctgcgctcggcggggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccgcggcgcgaagcacctgtccccaatcttccatccccgacgccccttcccgggtacccccctcc

SEQ ID NO: 122053 - DNA, 38 bp, Homo sapiens; identical to SEQ ID NO: 39941
  chr3:56718243-56718281
  Hypo

SEQ ID NO: 122054 - DNA, 35 bp, Homo sapiens; identical to SEQ ID NO: 91220
  chr3:57040464-57040499
  Hypo

SEQ ID NO: 122055 - DNA, 32 bp, Homo sapiens; identical to SEQ ID NO: 91221
  chr3:57198549-57198581
  Hyper

SEQ ID NO: 122056 - DNA, 54 bp, Homo sapiens; identical to SEQ ID NO: 91222
  chr3:57204154-57204208
  Hyper

SEQ ID NO: 122057 - DNA, 28 bp, Homo sapiens
  chr3:57740997-57741025
  Hypo
gagccaccgcgcccggcctaattgctac

SEQ ID NO: 122058 - DNA, 205 bp, Homo sapiens; identical to SEQ ID NO: 91224
  chr3:57882410-57882615
  Hypo

SEQ ID NO: 122059 - DNA, 35 bp, Homo sapiens; identical to SEQ ID NO: 91225
  chr3:57978698-57978733
  Hypo

SEQ ID NO: 122060 - DNA, 187 bp, Homo sapiens; identical to SEQ ID NO: 39943
  chr3:58456517-58456704
  Hypo

SEQ ID NO: 122061 - DNA, 140 bp, Homo sapiens; identical to SEQ ID NO: 91228
  chr3:58571263-58571403
  Hyper

SEQ ID NO: 122062 - DNA, 106 bp, Homo sapiens
  chr3:58572688-58572794
  Hyper
cagcactgctggccccgcgagcgcacagcaggagcgtagtccggagccgaagcgcctccgcgacggtgacgcggccccaagtcccaaaccccgctgagggtcaagt

SEQ ID NO: 122063 - DNA, 30 bp, Homo sapiens; identical to SEQ ID NO: 91229
  chr3:59034636-59034666
  Hypo

SEQ ID NO: 122064 - DNA, 182 bp, Homo sapiens; identical to SEQ ID NO: 91230
  chr3:59223755-59223937
  Hypo

SEQ ID NO: 122065 - DNA, 30 bp, Homo sapiens; identical to SEQ ID NO: 91231
  chr3:59690756-59690786
  Hypo

SEQ ID NO: 122066 - DNA, 30 bp, Homo sapiens; identical to SEQ ID NO: 91233
  chr3:61341365-61341395
  Hypo

SEQ ID NO: 122067 - DNA, 30 bp, Homo sapiens; identical to SEQ ID NO: 91234
  chr3:61546138-61546168
  Hyper

SEQ ID NO: 122068 - DNA, 60 bp, Homo sapiens; identical to SEQ ID NO: 91235
  chr3:61548153-61548213
  Hyper

SEQ ID NO: 122069 - DNA, 91 bp, Homo sapiens; identical to SEQ ID NO: 28200
  chr3:61548917-61549008
  Hyper

SEQ ID NO: 122070 - DNA, 42 bp, Homo sapiens; identical to SEQ ID NO: 91237
  chr3:61550498-61550540
  Hyper

SEQ ID NO: 122071 - DNA, 92 bp, Homo sapiens; identical to SEQ ID NO: 91238
  chr3:62305001-62305093
  Hyper

SEQ ID NO: 122072 - DNA, 32 bp, Homo sapiens; identical to SEQ ID NO: 91239
  chr3:62351431-62351463
  Hyper

SEQ ID NO: 122073 - DNA, 1760 bp, Homo sapiens
  chr3:62353296-62355056
  Hyper
ccaagatctcccagacgtaatggggggagagcgctaataagacactattgtactatatgaggacaaggaaagggagctgactccttaaaccggcctgcagtctccctggggatagatgtctgggaaaagcaaggcgatattttcatatccttagccgccaagtcctcctcgcccatcctggggtttcctggggtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctccactgaagcgcaggcctcctaaaacccccggagttcgaattcctgctctaccaagcctggtgaccccaggcatgtcacatagttcatctctgcctctatttctccgtctgtagagtgggaataatcatgcccagcttgagggttgtagtcaccgttcgagaggatgtgtgttaagttcctggcatagagcaagccctcgggagatgacagggttttcgctagtggaaaccactggcactctcagcactgagcgcctactgtataccaggtgttgggcaaacccgcactccagtcactttctgagttacttggcggagtgagggggtgccctttgcgttaagcatctttcccttcaaatagtcgcctcccgccgtggaaatacgcgtggggtcagctcccagccacactcgccccctcaatggggaggttgcgtggaagcgcactcccgggccccgcgccgcacttcctcctggcgctggggaacattgttccaagagacgtgggctgaatcgccgcgcggatattaaaagtgtgtgtggggggaggcccggagcgacgcgccagtaatccgagctcttgattatccagattcggatcaaacggggcggcggcggccggccccctcctgggaatgattagatgattaatgtaatgctgtttgaagggtctctgttttctctcttaatttgggtcattacttagaaagcaagcgtgagatcatttcatcagcgtgctcggcagcagagatagctattcaggaaatgggctaacggagcggtaatcaggacccaggaggcggcggcggcggcggcagcgagctcggggagcccgggcgcgccctccggcggcagggctcagggcaccgggaggccagccccagaccgagagcgcaggccagtgagccccgaggctctggctggcctgggggacccttaccctccagttctcgccgccaagggagattgggagcggtggttgccctccttaggtctcccggagaaggggacgcgcccagaagctctccggtggggtagggcgtagatcgcttaccctcgcggggcgtggcgctttgctcaaggacgctcccaaaagctgctccccaacacccagtcgcttttaacccttt

SEQ ID NO: 122074 - DNA, 3324 bp, Homo sapiens
  chr3:62355300-62358624
  Hyper
ttgctgagctgacctcgccgcgaggggagagggggaaaaaaacgcgcactaatgattctgtttattgagttatatatgtatatattccgtgttcgcttgtacaggaggatttacatggctgtataaagatggctaggggcgccgcgctcttctggggcgctcacggtgacaggctggggttaaaactggctgccccaggagaagcggaggcctggaattaaatacgtttcggcgcactggatttaaataagtttcctgaatatacaaaggtgggggccacgagtttgctgccagtcatcgaggaaacatttagctttccaaaaatatgctggtttcgataaatagattttagcctctctgctatagtttttttttcttttaattttagaaataagtttatatgtgtgatctgttttcaggtggtacagggagggaaggaagggcaaggcagtagctctcagctctgcactgtcctagtcaggtcctttgcggagggggcagcagggcccacgctgtcgtggagtttgcgcacatgtttctttaagtcaaagtttctgcaaaaccctttgccgcaagtggcgcacgtgaaaggcttcttgtcgttgtgggtgtgcatatggaaggttaggttgtagacctggtggaaggccttgttgcagatggtacatttgtactgcttctcgccgctgtgggtcagcttgtggttcttgtagttccctacaacagatcaagaacaaaaaacgtgggggtatggagtagaatggtggggaggaagaggcgggcgtcccaggggcagcccaggtgcctgctcaaaaaaggcgacgcttggctaggcgggcgcgacctcttcgagtgaagaagttgtcaaacttcgtaagcgtcaagccgggtgctctcccgacaagaccgagactgagtcccgcggagccgctctgcgctcctgctctgcccgccacagaggctggtgcagcttccctcccgccgcgctccgcgggccgggaaacttttgcgtagcccagagacgcaccgagtccttctcctggctgatgcctcgctagaagaaattcgcacgaacccgggcttcatcctttttcttttcccccttctcatttttaaagttacttctttctcgccccccaactaccaactgaagatccaaaagtgccttggaaaatccgatccaggggccaaggatcataccggtttcccccaatcttagattgttcccgggagggttattttgcctccaatatttttcatttgaaagggaagttccggatacaaaaggaacctttttctatagggcaataccctctccttttcctacatcctttccttctgtccccgtgcttccttcgacctctcgaattcggagtctctcagtgcacccagcctgcatacagcgtggtctactaaccccgctaggagagcttccccctacaccaggcacaacccgattctaaagaaatgctgcgcccgcgcctgcagatttcgccttctctctccagatccctctttgccttcctgccagccagccgcgacccgagtcctgaggtgaggtgagaagagaaggcctcgcctggcacgttacctttttggtgaaagcctttgccgcaaaattcgcagacgaagggcttgtagcccgcgtggatgcggatatgcgtgttgagcgtggagctgcggttgaacgctttgccgcactggttgcatttatgtggcttttcctgaggaaaggggcgagtgcacagtaaggagaggccacctcgggaacacctggaagggacatcccccccacccccactcaaccctagagggtaagggataatctttggccatcgtatccccggtgttatcactaagattctgggggttgcgcgcgggctaggcccgacccgggggccacgtacctgggtgtggataattttgtgcctgcagagcgtgctggcctggcgaaagcctttgccgcagactttgcacacgaacggtctggctccggtgtggaccggcatgtggcgggtgagattatagtgagcgttaaacacctatggaaagacatggggggccttgtggtgcgtctgtccgagggcctacaatcagccccgggggggccacagcctacctcccccaaccaacacccccttcagaaaccagagcctttttcagtttgtaaagtgctgcccaaactcctgcttacaccaatactgtgtggccgctgacaagggcatccccattttacagaataggaaactgaggcccaacgaggctcccagtttgggtagtcaactactggggagctcctcagcttgaaaaaggggcattccaggctgccccaaggaagccgccgccgccgatcgcccctcccggcccccctcgccgaaccctgggcctcaccttgccgcacacctcgcaggtgaagtttttgggcttgccatctgcggagcctcctggcagcttgctgtggcccttgacgcctccgcgctcggcagtcagggccgagttttccttcagtacctgctccagcggcgccggcaagcgctccttatggggatagggagccgggtgggggaacttgtccgcagccaggccggccagcttggcgttctccagcagaaagagcttggggtgagcagccagggcggcgggggcctgcgcattgaggaggccagacgggaagaggtggccgctgaggagctcagacggcgggtacgcggtcgagtccaggtagttgaagtagtagagcgagccgctggccggcagccccacagcctggttgatgacctgcggcttgatgaccctgcccgcgggcagcgcggacggcgccaggcccagctcggccttgcagcacacgccacagttggttttgcacaagccgctggcgccgcacactggggcccccccgccgccgccgccgccaccgccgccgccgcctccgccgccgcccgcccggaggctgcttttccagagctccgagtaactgagcagtgtctttgacggcacctcgtagcctaggggctggagggggatcatacagggcagcggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaagccgagcttgccatggcgcgcggagctgagccgagccaggctgggccagggcgcagcctctctcctctaagtctgcattccggaaaaggcagggg

SEQ ID NO: 122075 - DNA, 1777 bp, Homo sapiens
  chr3:62358858-62360635
  Hyper
gcccttccctggacccgggcctctgccacgcgtgctgggagctggacagtgaaggggcaaagttaaagaggaccggagagccacctcgcatttacctctttcccccaccaccaaggagatgcgttccgagccatgcagcgtgtctcttctgtcacattttgatggcaaacatcttcccctccgcgtgagatcactgtcttttacattcagctgacatcacatgaagtcacttgaagtggaatgacatgggcggcggcgcggctcccgtagcggcccctgtgttcccccgcgcctgccggccgccgccaccaccgcccctcaaactttaaaaggaggcaactggcgcccgcgctcctctcgggaaagtgcgagcggtttgcgaatagggaaagagggaagagacgggagggggagggggaggaatcgtgatggttttgccggtggaaggaaagggggggggggacccaaacccaaacctaggcagagttccgtgcgtgattcacaactttggaggcctgcaggtttgggggacgcggggagggcggagggtcccggacgcggcgcccccaaagggcccctgggtatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtggtcgaggctgagggttcttacggaggggggtggtggtggctagcaagagagcgagcgagagaattaggtttaggaaagggggaggactgggtgcaagggttttttgaaaagttttggctggttttgttcgcgggacaattatatc

SEQ ID NO: 122076 - DNA, 415 bp, Homo sapiens
  chr3:62362698-62363113
  Hyper
gccctgtgtaatccccgggcgcccaggcccgtggccttccgattcgctccatggcgtgggttgcagcccgtcacgcacggccgccgggcccgaatccaccttggcgccttccctagcccgaggcctcagccccaggcctatttcacttggagcgcctcagcctagagccggacgctttggcttcttcgccatctggccctaggttgggcctcaaactcccggcggcggtagggaaacagacgatcacagttaggcctgaggcccctcggcggcctgtgtccttcccacgccgaagaacaaggcgccaaggccgggcgcgtccgctgctctgcggggcctgaccggggcggcgacctctgggatccgcggcggtgcgacgccgcgccctggccaagcaacccgcacaccactgact

SEQ ID NO: 122077 - DNA, 1702 bp, Homo sapiens
  chr3:62363424-62365126
  Hyper
aaaatccctttcttgcgcaaaaagctcacacatttgcaccacggaagaaaaaggcaagcatttccactccaaaaagtgttccaatttcagcccctgtggcatgcatatcttggttctggatgacaaggggcactattattttaaaaaccgttattattttttcatctggttgcaatacataacacagcgccctatgtatgccatctccccagggagccgagcagcttgggaggagaaggcttgcttgcggctcccgagtttggggaaacacgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatctgatttacttggtgccgcgcttaaccgctgctgaaaatagattaacttctgaagagaaattcttttgctatcctctcttttttccccaggaagcattttattgaaaacattcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagcacgcaagcacagtcccaggcctttagggacagatgggccagagccgtctgcatctgcccgcatcctttgggaggctgcgatgatcgcagccagggtggccgagcgcccggcccactgcacccggcggctgttttgcagcgcccctggcattcagggaatggtttgcaaatctcaatgcaccacagactagttttcaccgtggagcaggaaaggcgcctattagccaggggcaaccggctttgcagacctgggcgggggcgtagggggaggggcggtggtgcaaacctatcgtgatttccaggatcctcccaactccctccgctatcacatcagaggacattcgctgactcttcggaaatctgggcagcgaatacacttctaggccagaagaattctcctaaaagagcagatctgcagtctatccgtgcaagcttagtactctcctctctgccctggatgcatatatattcacaaacatatatatgcatatcatatatatgcatattgtttatatgtatgtatgtatatacttatatactatcggcaacccatcactagaaatgctatttaattaggaatctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 122078 - DNA, 73 bp, Homo sapiens; identical to SEQ ID NO: 91256
  chr3:62859891-62859964
  Hyper

SEQ ID NO: 122079 - DNA, 1156 bp, Homo sapiens
  chr3:62860169-62861325
  Hyper
cctcctcgccagctgcgccgccagctcccattgttcaccccgcccgcctggcgacgtccgggtgctgctccctgggcctcccaggcgcacctaccttctgctgccggcgagccatgtcggtgggctgcttggcattaaaggggtaggcgatgcagcgcatcacgaacacatacagctgcagcctcttcttcctctcctcctcctctttctgcagccgctccaactcttccttctccttctcgctcaccaccgacgggctggggctggagggccggccgccgccagcgcggctgctgggttgcagccccccggccccgccgccgctgctcgcgccgctgcccccgccgccgcctgcacccaccccggctccggcgccggcgccgccgccccccagcccggcgctgccggccgagccctcgctggtacggctgggagacaggcgcgcgccggacggggccgagccgagcacctccttgccgctctcctcctccacgatctcatccgattcttcttcgctggacgaagggtccagcatagtggcgcctggggagcggggtctctggagcccccggcttggagtgcaaaaggtggggggcgctggaggcagccggggatcagctctcccgggtgggcgcttctccccaggtcagggagcgagagcgctgctgctcagcctcggccgccgcgactgatcctctgcccggcggtcgcgagctgggctcagacccagaagcgcgaagggaggaggggaagggagaggtgcgtccgtggactcgaggtgggcaagggggagaatcaattgcgagccccgagcccgcagccggatgccatctgcggctgctgaaggaggcgcctccagaaaagatgccgagtgttgcaagctgtcgatgcagccaagagccgaagaggcatcttgccgattggggagggagcggcgcttacgtgtttattggcttaactctcccgtgtccgcggcgtaaagggctgctgcagagggctggaggggggagagcgcggagcgtcctcagagcctcagtacttctgaccccaataccttgccaccctcctcccctgccggcttcgtggataatttttttgttgatatctggctctcattgcctcaaccccttttcccctcccgcggacaaaaagttct

SEQ ID NO: 122080 - DNA, 127 bp, Homo sapiens
  chr3:62861812-62861939
  Hyper
accctaagaactcagcggcgtcaacatctaatgcgtcgactgtcgcactctgttcacccctgcctctcgggtaaactattaatacaaagcagcagatggtgcctgccttccccgtgctcctttcact

SEQ ID NO: 122081 - DNA, 271 bp, Homo sapiens
  chr3:63263759-63264030
  Hyper
tgatggtgccaagcccgctttcccaaaccaacagacccaaagtttccccggagccagagggcaccgggcgcacggctgagcctgcaccaatgtctgtgggccctgcctcgcccacctcctcgccctcccctctggagcgcggctggccaatgacagccttcccctggctccatgggtttccccctcccctgttgtatctaccctgccccagctcttccctgcccacccctcgctgactcgcttcgcttccccgacgcgctgggttcccgga

SEQ ID NO: 122082 - DNA, 586 bp, Homo sapiens; identical to SEQ ID NO: 28224
  chr3:63264254-63264840
  Hyper

SEQ ID NO: 122083 - DNA, 169 bp, Homo sapiens; identical to SEQ ID NO: 91262
  chr3:64007991-64008160
  Hypo

SEQ ID NO: 122084 - DNA, 335 bp, Homo sapiens; identical to SEQ ID NO: 28225
  chr3:64430570-64430905
  Hyper

SEQ ID NO: 122085 - DNA, 30 bp, Homo sapiens; identical to SEQ ID NO: 91264
  chr3:64670902-64670932
  Hyper

SEQ ID NO: 122086 - DNA, 77 bp, Homo sapiens; identical to SEQ ID NO: 91265
  chr3:64671655-64671732
  Hyper

SEQ ID NO: 122087 - DNA, 375 bp, Homo sapiens; identical to SEQ ID NO: 91266
  chr3:64672038-64672413
  Hyper

SEQ ID NO: 122088 - DNA, 156 bp, Homo sapiens; identical to SEQ ID NO: 91267
  chr3:64673263-64673419
  Hyper

SEQ ID NO: 122089 - DNA, 30 bp, Homo sapiens; identical to SEQ ID NO: 91268
  chr3:64674179-64674209
  Hyper

SEQ ID NO: 122090 - DNA, 30 bp, Homo sapiens; identical to SEQ ID NO: 91269
  chr3:64785423-64785453
  Hypo

SEQ ID NO: 122091 - DNA, 398 bp, Homo sapiens
  chr3:65534983-65535381
  Hyper
cctcttcctcattcccgcccagtctccttcctcccttcctaaccccctcccctcccctcttcctgctgtcacttccaaacccaaggacaaaaccgttacctgcgggccccggagcggccccggagttcgcctcggtcactgccggagcccaggcgcgcgctcggtggccgcccgcctcatccccgcgcgtctgagcggcccggcggcagctgctccttttatggggctcgcaggcagtaggctcggccagggtgtccccagcccgctcgggcggcagcggcgtcaatgcgcgctattcacactccgggctgcggctggtacccctctacacgccccccgggagtgcgcgactgcctgcccgcccccatcctcagggccttggacgggggtaggggtgg

SEQ ID NO: 122092 - DNA, 66 bp, Homo sapiens; identical to SEQ ID NO: 91273
  chr3:66025440-66025506
  Hyper

SEQ ID NO: 122093 - DNA, 26 bp, Homo sapiens
  chr3:66618027-66618053
  Hypo
acctttggccaggtgcggtgactcac

SEQ ID NO: 122094 - DNA, 30 bp, Homo sapiens; identical to SEQ ID NO: 39944
  chr3:67047776-67047806
  Hypo

SEQ ID NO: 122095 - DNA, 30 bp, Homo sapiens; identical to SEQ ID NO: 91276
  chr3:67066758-67066788
  Hypo

SEQ ID NO: 122096 - DNA, 276 bp, Homo sapiens; identical to SEQ ID NO: 91277
  chr3:68056904-68057180
  Hyper

SEQ ID NO: 122097 - DNA, 30 bp, Homo sapiens; identical to SEQ ID NO: 91278
  chr3:68777755-68777785
  Hypo

SEQ ID NO: 122098 - DNA, 1280 bp, Homo sapiens
  chr3:68980768-68982048
  Hyper
atctgagatgcctcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtgggggcggggggacgctgaccggctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggctgcccacgagacagcacctaaatacagggtccaaatccacccccaccccatcctctcgcccctccttatcccttccaacccttcttactcgactagagccggcatccaagtcggaccggcgcgtccggaactaggtactgatcgccgcaccggagcccgaggacgctcaccgtgccgcctccccgcgggagccccgggagcggcccatcacctctgcagcctcgccaggagaagaaaagttcccacgtctctaccaggagaagcccgaagctcctgcgggagaagcctgaagctgctgctggagaagcggcagctgaggcaggactcccgatgtttgcccgcagccgcgcgcgcagtcggtgcgccccgtccagggcggcgcgcagctagcagtgcggagccgagcccagctagcgcgctgaccaggaggggccgggcccgccgcggaacgcgctgattggccgggccgcccggctgctcctgtccctgcctggccccgcggtccacgtgggccggccttctccccgccccgcacccctgctcaggcggcgcgcccccactgccggcctccaggcgcctctcccgagcgcctcgctgtggccaccactccgcaggtgctgagcaaaaggtattcttcctgaatacctgagagtcgcgttgagctccacataaggaagacggatttagggttcggctctcactcgaaaccattctccacgcaggacccaaagcggtttgcaagcagg

SEQ ID NO: 122099 - DNA, 30 bp, Homo sapiens; identical to SEQ ID NO: 91288
  chr3:69313995-69314025
  Hypo

SEQ ID NO: 122100 - DNA, 511 bp, Homo sapiens; identical to SEQ ID NO: 91289
  chr3:69435147-69435658
  Hyper

SEQ ID NO: 122101 - DNA, 228 bp, Homo sapiens; identical to SEQ ID NO: 91290
  chr3:69459574-69459802
  Hyper

SEQ ID NO: 122102 - DNA, 1320 bp, Homo sapiens
  chr3:69590888-69592208
  Hyper
aaaagggcagccaaacgaaacccttagtgtcctctgctaactccagggatttcccccccctcttttcgctgccttttagaagtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaagcgaccaaagcgccgtgccaagtgccccagggactccagcggaggctgcactagacctcgagccccagggcggggttttccgctctcccaaactcctgggacccgcacctccgctgggggtctccaaacgtgcgcgctgcgcccggggcgcaccgggcgcgcccgtggccgcgtcttgcggcctcgccctggcagcacgcttggggagcccggggcggtcgcccacctacctgctccgccacctcctccctgcggcgctccggggctgtagacggctactttattgtctcggctgcgcaccgcgcgggacctggggacccggctctgcgccagtcctgcaagtccactctgcgctgtgccttccccggcggcggctgccttcctcttcttcctcttcctctctgtccaagctccagctcagcacgtgagctacgcagcccgactcccgggctctctgggcagccagcgcctgccgcatcccccggcccgggtctgcaggtcgcccccgccaccgccgctcgccgtgcgtcctcgctttgctccacacttacagctgtgccccgggccgcctttctcgcgtccttccgtcctgcctgcctcctctcgctgtcagccggggctttcggctccctctctccccagcagcccccgcccgccgcctctccgggggctggggcggccgctgccaatgaggctcggctgatgcgctgttccggcccagtcattgtatcgggagggaaggaaggggagggggagagggaggaagggagggggcgccctcggcccccgccgcacggggctgcgggctgggctagccttccccggcagagaaagggcgccggtgccaggaggcgcggagcggtgcctgccaggaggaggggaaagagggggtcaccagcccgcgcctctccatcgctccctccgactcctccaagctctgggcggaacttgattctgcctcaccggcttcaggcatcccaggacctgagtgctgttagaataaagggtatgaggcaccggtggcagagggaggcgcagaatgcacccagccacccaagaggggctggcgaaatgactcctga

SEQ ID NO: 122103 - DNA, 81 bp, Homo sapiens; identical to SEQ ID NO: 39946
  chr3:69741003-69741084
  Hypo

SEQ ID NO: 122104 - DNA, 30 bp, Homo sapiens; identical to SEQ ID NO: 91296
  chr3:69937866-69937896
  Hypo

SEQ ID NO: 122105 - DNA, 27 bp, Homo sapiens
  chr3:70083704-70083731
  Hypo
ttttgttctgccaggcgtggtggctca

SEQ ID NO: 122106 - DNA, 304 bp, Homo sapiens; identical to SEQ ID NO: 91298
  chr3:71179297-71179601
  Hyper

SEQ ID NO: 122107 - DNA, 30 bp, Homo sapiens; identical to SEQ ID NO: 91299
  chr3:71187389-71187419
  Hypo

SEQ ID NO: 122108 - DNA, 36 bp, Homo sapiens; identical to SEQ ID NO: 91300
  chr3:71510928-71510964
  Hypo

SEQ ID NO: 122109 - DNA, 219 bp, Homo sapiens
  chr3:71802569-71802788
  Hyper
ccaccgtgaccccagcgcgggcgccgccgccggacccccgttacctggggccaaacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggagggg

SEQ ID NO: 122110 - DNA, 1179 bp, Homo sapiens
  chr3:71802848-71804027
  Hyper
ggcggggggcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaatt

SEQ ID NO: 122111 - DNA, 185 bp, Homo sapiens; identical to SEQ ID NO: 91306
  chr3:71833566-71833751
  Hyper

SEQ ID NO: 122112 - DNA, 769 bp, Homo sapiens; identical to SEQ ID NO: 91307
  chr3:71833976-71834745
  Hyper

SEQ ID NO: 122113 - DNA, 119 bp, Homo sapiens; identical to SEQ ID NO: 91308
  chr3:72149958-72150077
  Hyper

SEQ ID NO: 122114 - DNA, 30 bp, Homo sapiens; identical to SEQ ID NO: 39948
  chr3:72305951-72305981
  Hypo

SEQ ID NO: 122115 - DNA, 30 bp, Homo sapiens; identical to SEQ ID NO: 91310
  chr3:72321838-72321868
  Hypo

SEQ ID NO: 122116 - DNA, 188 bp, Homo sapiens; identical to SEQ ID NO: 91311
  chr3:72647815-72648003
  Hypo

SEQ ID NO: 122117 - DNA, 30 bp, Homo sapiens; identical to SEQ ID NO: 91313
  chr3:72742498-72742528
  Hypo

SEQ ID NO: 122118 - DNA, 30 bp, Homo sapiens; identical to SEQ ID NO: 39949
  chr3:72773579-72773609
  Hypo

SEQ ID NO: 122119 - DNA, 369 bp, Homo sapiens; identical to SEQ ID NO: 91315
  chr3:72787939-72788308
  Hyper

SEQ ID NO: 122120 - DNA, 81 bp, Homo sapiens; identical to SEQ ID NO: 91316
  chr3:73045023-73045104
  Hypo

SEQ ID NO: 122121 - DNA, 81 bp, Homo sapiens; identical to SEQ ID NO: 91317
  chr3:73045524-73045605
  Hypo

SEQ ID NO: 122122 - DNA, 172 bp, Homo sapiens; identical to SEQ ID NO: 91318
  chr3:73498616-73498788
  Hypo

SEQ ID NO: 122123 - DNA, 320 bp, Homo sapiens
  chr3:73673904-73674224
  Hyper
gaccttgtggcacagcgcgcacttcaggtccgggtccacgtcgccgtcgaagcggtccagctcgaagcccatggtggcggccaggccccggggtcgccgccgggcggccgggcgccccctccctccccacgaggcggcccagacaggccggctacgccgcccgcgcgctcgctggctctccccggactgagcctaattgatccagacttcctcggaaaatgcccgaggaacaggactcctccggccgtatttgcgcgagcgcgagcgcacatacatcgtgccttggatgcctcccgccagccccccgaaaaagggaggag

SEQ ID NO: 122124 - DNA, 30 bp, Homo sapiens; identical to SEQ ID NO: 91320
  chr3:73674657-73674687
  Hyper

SEQ ID NO: 122125 - DNA, 367 bp, Homo sapiens
  chr3:74663814-74664181
  Hyper
gtgcctccgccactccggctccggctccggctccgacgcggacgctggagggaggggagaccgggcggactggagggagggaggggcggggagcgcggcggagcagccaactgggtcccgagcctcgcgtctgcggcgcccccagcgcctctgcgccggccggaccccgcgcggccctgcgctcggccgcgtgcacccacgtgtgtccggcctccgcagggccctgggcggcggcgcgggctgggcggcggtcaccgtgtcacctccgggtggcctcgtgccacgcagttagggccctcggaacacggggttaaggcaggaattccacttctagaaaagcctcctgcagctgcgctcccacaagtgc

SEQ ID NO: 122126 - DNA, 629 bp, Homo sapiens
  chr3:75955796-75956425
  Hyper
gaccgggaggagcctcgagcctgctcattagtagcacgggcagctcgcgcgctggaggagggaggcggaaggacagcgctgcgccaccacccggaggagggagcgcggtagctgcaggcaggggagggagaggaaagaaaaggaaggacggctcccagacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccaggtgagttcggcaaagaggtgaaccgaggggtctcgaaccagagacgtggcattggcgaggctgctcagctcccccaagcgctgctgcctttatatttcccaaattcacggaaggtcttggcggtggctgcacaggctgggagggggcggagggtcggtgggtggttgcgatcctcacggccagcgtgggggcattcggatggaattagcttaagtgaatggggttttaggaaatgtccccaaaggcacgcgttatatatgtgtttctagacaagcttttaagacggaaatttggtttcccggatgccctttttg

SEQ ID NO: 122127 - DNA, 67 bp, Homo sapiens; identical to SEQ ID NO: 91328
  chr3:77089144-77089211
  Hyper

SEQ ID NO: 122128 - DNA, 60 bp, Homo sapiens; identical to SEQ ID NO: 28251
  chr3:77089428-77089488
  Hyper

SEQ ID NO: 122129 - DNA, 170 bp, Homo sapiens; identical to SEQ ID NO: 91330
  chr3:77918482-77918652
  Hypo

SEQ ID NO: 122130 - DNA, 33 bp, Homo sapiens; identical to SEQ ID NO: 91331
  chr3:79067168-79067201
  Hyper

SEQ ID NO: 122131 - DNA, 194 bp, Homo sapiens; identical to SEQ ID NO: 91332
  chr3:79068137-79068331
  Hyper

SEQ ID NO: 122132 - DNA, 448 bp, Homo sapiens; identical to SEQ ID NO: 91333
  chr3:79815465-79815913
  Hyper

SEQ ID NO: 122133 - DNA, 136 bp, Homo sapiens; identical to SEQ ID NO: 91334
  chr3:79816272-79816408
  Hyper

SEQ ID NO: 122134 - DNA, 222 bp, Homo sapiens; identical to SEQ ID NO: 91335
  chr3:79816778-79817000
  Hyper

SEQ ID NO: 122135 - DNA, 142 bp, Homo sapiens; identical to SEQ ID NO: 91336
  chr3:79817216-79817358
  Hyper

SEQ ID NO: 122136 - DNA, 30 bp, Homo sapiens; identical to SEQ ID NO: 91337
  chr3:85000786-85000816
  Hypo

SEQ ID NO: 122137 - DNA, 1088 bp, Homo sapiens
  chr3:85007729-85008817
  Hyper
tgcgcagaagaacctcgcacccaggacctggcccaggcaccacgaattccagaacatgctggggacacggctaaccccgccccctcgcggtggcgattggctgaacccttcctgagtgcaaagcgctgattaatgaaggcagttgtctcgcctgcaagttcgggcgagacatctctaaagaggtaagatccgccaggggtgctgaatgggggcttcagttcttcctgcccgaagggtccttgagaagcctgtttgtttttcccggcgcttgtctccacccatccccttctctcattggccagacctggtgggcgggggagtttccattggccggggggcggtgtctgtccctggccggggtgggggcggggcctccgccgctctgagcttgcccttgtgtctggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctaca

SEQ ID NO: 122138 - DNA, 104 bp, Homo sapiens; identical to SEQ ID NO: 91340
  chr3:85009234-85009338
  Hyper

SEQ ID NO: 122139 - DNA, 96 bp, Homo sapiens; identical to SEQ ID NO: 28259
  chr3:85009769-85009865
  Hyper

SEQ ID NO: 122140 - DNA, 40 bp, Homo sapiens; identical to SEQ ID NO: 28260
  chr3:85010590-85010630
  Hyper

SEQ ID NO: 122141 - DNA, 30 bp, Homo sapiens; identical to SEQ ID NO: 91343
  chr3:85393239-85393269
  Hypo

SEQ ID NO: 122142 - DNA, 145 bp, Homo sapiens; identical to SEQ ID NO: 91344
  chr3:86061726-86061871
  Hypo

SEQ ID NO: 122143 - DNA, 86 bp, Homo sapiens; identical to SEQ ID NO: 91345
  chr3:86960155-86960241
  Hypo

SEQ ID NO: 122144 - DNA, 892 bp, Homo sapiens; identical to SEQ ID NO: 91346
  chr3:87039656-87040548
  Hyper

SEQ ID NO: 122145 - DNA, 30 bp, Homo sapiens; identical to SEQ ID NO: 91347
  chr3:87128365-87128395
  Hypo

SEQ ID NO: 122146 - DNA, 38 bp, Homo sapiens; identical to SEQ ID NO: 91348
  chr3:87226517-87226555
  Hypo

SEQ ID NO: 122147 - DNA, 163 bp, Homo sapiens; identical to SEQ ID NO: 14551
  chr3:87782694-87782857
  Hypo

SEQ ID NO: 122148 - DNA, 395 bp, Homo sapiens; identical to SEQ ID NO: 91350
  chr3:87841397-87841792
  Hyper

SEQ ID NO: 122149 - DNA, 354 bp, Homo sapiens
  chr3:87842058-87842412
  Hyper
gaaggggtgtggggacgtggggagtgggaggctggacagcgcttgctctcggcggaaacgctgggaagccggcgccaagtcctttcccacactactttgatctaacagcgcaggaattcaagaattgccctttcccttttctgcccacaacctctgctccctgggggcgaagttctgtggtgctaggcggagatagtggtcaaggctgggaggaagggaggggtctgacccgggcccaagggcgaggggtggcggtccaagccggcgagaccccacttagggcgcaggctcctggcgctcctacctcgggaagccgctggggtggagagagacggggcacgggccagaatccag

SEQ ID NO: 122150 - DNA, 38 bp, Homo sapiens; identical to SEQ ID NO: 91353
  chr3:87881745-87881783
  Hypo

SEQ ID NO: 122151 - DNA, 27 bp, Homo sapiens
  chr3:88248022-88248049
  Hypo
accccgcccgcccgattctttaacatt

SEQ ID NO: 122152 - DNA, 22 bp, Homo sapiens
  chr3:89098883-89098905
  Hypo
gggcgcggtggctcacgcctgt

SEQ ID NO: 122153 - DNA, 73 bp, Homo sapiens; identical to SEQ ID NO: 28266
  chr3:89156550-89156623
  Hyper

SEQ ID NO: 122154 - DNA, 44 bp, Homo sapiens; identical to SEQ ID NO: 91360
  chr3:89157055-89157099
  Hyper

SEQ ID NO: 122155 - DNA, 25 bp, Homo sapiens
  chr3:89219100-89219125
  Hypo
ttgagattatagcctcggcggggcg

SEQ ID NO: 122156 - DNA, 40 bp, Homo sapiens; identical to SEQ ID NO: 91365
  chr3:93698209-93698249
  Hypo

SEQ ID NO: 122157 - DNA, 30 bp, Homo sapiens; identical to SEQ ID NO: 39959
  chr3:93801136-93801166
  Hypo

SEQ ID NO: 122158 - DNA, 160 bp, Homo sapiens; identical to SEQ ID NO: 91374
  chr3:96147753-96147913
  Hypo

SEQ ID NO: 122159 - DNA, 1704 bp, Homo sapiens; identical to SEQ ID NO: 91375
  chr3:96532078-96533782
  Hyper

SEQ ID NO: 122160 - DNA, 61 bp, Homo sapiens; identical to SEQ ID NO: 28271
  chr3:96534035-96534096
  Hyper

SEQ ID NO: 122161 - DNA, 113 bp, Homo sapiens; identical to SEQ ID NO: 91377
  chr3:97200376-97200489
  Hypo

SEQ ID NO: 122162 - DNA, 31 bp, Homo sapiens; identical to SEQ ID NO: 39961
  chr3:98029454-98029485
  Hypo

SEQ ID NO: 122163 - DNA, 16 bp, Homo sapiens
  chr3:98161422-98161438
  Hypo
gcgtgagccaccgcgc

SEQ ID NO: 122164 - DNA, 42 bp, Homo sapiens; identical to SEQ ID NO: 91382
  chr3:98170629-98170671
  Hypo

SEQ ID NO: 122165 - DNA, 42 bp, Homo sapiens; identical to SEQ ID NO: 91383
  chr3:98313028-98313070
  Hypo

SEQ ID NO: 122166 - DNA, 102 bp, Homo sapiens; identical to SEQ ID NO: 91384
  chr3:98313310-98313412
  Hypo

SEQ ID NO: 122167 - DNA, 61 bp, Homo sapiens; identical to SEQ ID NO: 91385
  chr3:98450986-98451047
  Hyper

SEQ ID NO: 122168 - DNA, 109 bp, Homo sapiens; identical to SEQ ID NO: 91386
  chr3:98451370-98451479
  Hyper

SEQ ID NO: 122169 - DNA, 686 bp, Homo sapiens; identical to SEQ ID NO: 91387
  chr3:98451685-98452371
  Hyper

SEQ ID NO: 122170 - DNA, 186 bp, Homo sapiens; identical to SEQ ID NO: 91388
  chr3:98452640-98452826
  Hyper

SEQ ID NO: 122171 - DNA, 41 bp, Homo sapiens; identical to SEQ ID NO: 91389
  chr3:98471752-98471793
  Hypo

SEQ ID NO: 122172 - DNA, 30 bp, Homo sapiens; identical to SEQ ID NO: 91390
  chr3:98555269-98555299
  Hypo

SEQ ID NO: 122173 - DNA, 41 bp, Homo sapiens; identical to SEQ ID NO: 91391
  chr3:98613834-98613875
  Hypo

SEQ ID NO: 122174 - DNA, 1072 bp, Homo sapiens; identical to SEQ ID NO: 91392
  chr3:98620054-98621126
  Hyper

SEQ ID NO: 122175 - DNA, 19 bp, Homo sapiens
  chr3:98902515-98902534
  Hypo
tttgagacggagtctcgct

SEQ ID NO: 122176 - DNA, 116 bp, Homo sapiens; identical to SEQ ID NO: 28277
  chr3:99356783-99356899
  Hyper

SEQ ID NO: 122177 - DNA, 423 bp, Homo sapiens; identical to SEQ ID NO: 91399
  chr3:99594891-99595314
  Hyper

SEQ ID NO: 122178 - DNA, 41 bp, Homo sapiens; identical to SEQ ID NO: 89952
  chr3:100211005-100211046
  Hyper

SEQ ID NO: 122179 - DNA, 34 bp, Homo sapiens; identical to SEQ ID NO: 89953
  chr3:100989020-100989054
  Hypo

SEQ ID NO: 122180 - DNA, 30 bp, Homo sapiens; identical to SEQ ID NO: 89954
  chr3:101021607-101021637
  Hypo

SEQ ID NO: 122181 - DNA, 164 bp, Homo sapiens; identical to SEQ ID NO: 89955
  chr3:101230477-101230641
  Hypo

SEQ ID NO: 122182 - DNA, 163 bp, Homo sapiens; identical to SEQ ID NO: 89956
  chr3:101230941-101231104
  Hypo

SEQ ID NO: 122183 - DNA, 98 bp, Homo sapiens; identical to SEQ ID NO: 89959
  chr3:101397204-101397302
  Hypo

SEQ ID NO: 122184 - DNA, 30 bp, Homo sapiens; identical to SEQ ID NO: 89964
  chr3:102435036-102435066
  Hypo

SEQ ID NO: 122185 - DNA, 30 bp, Homo sapiens; identical to SEQ ID NO: 89968
  chr3:104512166-104512196
  Hypo

SEQ ID NO: 122186 - DNA, 30 bp, Homo sapiens; identical to SEQ ID NO: 89971
  chr3:106136655-106136685
  Hypo

SEQ ID NO: 122187 - DNA, 41 bp, Homo sapiens; identical to SEQ ID NO: 89972
  chr3:106732480-106732521
  Hypo

SEQ ID NO: 122188 - DNA, 30 bp, Homo sapiens; identical to SEQ ID NO: 89973
  chr3:106824203-106824233
  Hypo

SEQ ID NO: 122189 - DNA, 16 bp, Homo sapiens
  chr3:106835414-106835430
  Hypo
gcgccctgccaaaggt

SEQ ID NO: 122190 - DNA, 38 bp, Homo sapiens; identical to SEQ ID NO: 89975
  chr3:106862938-106862976
  Hypo

SEQ ID NO: 122191 - DNA, 33 bp, Homo sapiens; identical to SEQ ID NO: 89976
  chr3:106936157-106936190
  Hypo

SEQ ID NO: 122192 - DNA, 67 bp, Homo sapiens; identical to SEQ ID NO: 89977
  chr3:107148996-107149063
  Hyper

SEQ ID NO: 122193 - DNA, 280 bp, Homo sapiens; identical to SEQ ID NO: 89978
  chr3:107149774-107150054
  Hyper

SEQ ID NO: 122194 - DNA, 30 bp, Homo sapiens; identical to SEQ ID NO: 89979
  chr3:107244633-107244663
  Hyper

SEQ ID NO: 122195 - DNA, 50 bp, Homo sapiens; identical to SEQ ID NO: 89981
  chr3:107632014-107632064
  Hypo

SEQ ID NO: 122196 - DNA, 215 bp, Homo sapiens; identical to SEQ ID NO: 89982
  chr3:107771800-107772015
  Hypo

SEQ ID NO: 122197 - DNA, 39 bp, Homo sapiens; identical to SEQ ID NO: 89983
  chr3:107833994-107834033
  Hypo

SEQ ID NO: 122198 - DNA, 91 bp, Homo sapiens; identical to SEQ ID NO: 89984
  chr3:108483736-108483827
  Hypo

SEQ ID NO: 122199 - DNA, 84 bp, Homo sapiens; identical to SEQ ID NO: 89987
  chr3:108829148-108829232
  Hypo

SEQ ID NO: 122200 - DNA, 30 bp, Homo sapiens; identical to SEQ ID NO: 89988
  chr3:109035016-109035046
  Hypo

SEQ ID NO: 122201 - DNA, 30 bp, Homo sapiens; identical to SEQ ID NO: 89989
  chr3:109787249-109787279
  Hypo

SEQ ID NO: 122202 - DNA, 280 bp, Homo sapiens; identical to SEQ ID NO: 89995
  chr3:110789454-110789734
  Hyper

SEQ ID NO: 122203 - DNA, 30 bp, Homo sapiens; identical to SEQ ID NO: 89996
  chr3:110790641-110790671
  Hyper

SEQ ID NO: 122204 - DNA, 215 bp, Homo sapiens; identical to SEQ ID NO: 89997
  chr3:110791320-110791535
  Hyper

SEQ ID NO: 122205 - DNA, 30 bp, Homo sapiens; identical to SEQ ID NO: 89998
  chr3:111197729-111197759
  Hypo

SEQ ID NO: 122206 - DNA, 34 bp, Homo sapiens; identical to SEQ ID NO: 39967
  chr3:111988003-111988037
  Hypo

SEQ ID NO: 122207 - DNA, 64 bp, Homo sapiens; identical to SEQ ID NO: 28283
  chr3:112052498-112052562
  Hyper

SEQ ID NO: 122208 - DNA, 183 bp, Homo sapiens
  chr3:112930328-112930511
  Hyper
cctcctcctcctcctcgcacggtaatgggaggctcctaggcaggagaagcaaaagaaggaattgtttgcgagttcagtcatccaaaaagcttcttccatatggagggaccgggtgcgctgggcgcggcgtcccctgcgttgtcctcctgctgccgcccccgcggccgccgctttctgccgcgg

SEQ ID NO: 122209 - DNA, 468 bp, Homo sapiens; identical to SEQ ID NO: 90004
  chr3:112930806-112931274
  Hyper

SEQ ID NO: 122210 - DNA, 58 bp, Homo sapiens; identical to SEQ ID NO: 90005
  chr3:112931566-112931624
  Hyper

SEQ ID NO: 122211 - DNA, 18 bp, Homo sapiens
  chr3:113557458-113557476
  Hypo
tttcgcacattggggcag

SEQ ID NO: 122212 - DNA, 208 bp, Homo sapiens; identical to SEQ ID NO: 90007
  chr3:113866148-113866356
  Hypo

SEQ ID NO: 122213 - DNA, 44 bp, Homo sapiens; identical to SEQ ID NO: 90008
  chr3:113958201-113958245
  Hypo

SEQ ID NO: 122214 - DNA, 30 bp, Homo sapiens; identical to SEQ ID NO: 90009
  chr3:114973219-114973249
  Hypo

SEQ ID NO: 122215 - DNA, 330 bp, Homo sapiens
  chr3:115231485-115231815
  Hyper
ggggctgcagaagcccgctgcgcgcctcctggtttctatggagaccctgcttgatgtcaatggcggctccggagcgcagggaaacctaagcgtttgtatttaaatgagggaaagtgggggaaggggaagtaaaagaggaagggaacagaagagaggatggtagaggtgagcgggcgggtgttgaactctggggactagaaaaatccagctgcgttactcagtcatctcatgctcgcggagaaatcagaggaagcagcagcgggcagaggggtgtttatttcttgcgtgagaaatatccgacttctttctgacatccgggagtaagggaca

SEQ ID NO: 122216 - DNA, 314 bp, Homo sapiens; identical to SEQ ID NO: 90012
  chr3:115377639-115377953
  Hyper

SEQ ID NO: 122217 - DNA, 76 bp, Homo sapiens; identical to SEQ ID NO: 90013
  chr3:115502397-115502473
  Hypo

SEQ ID NO: 122218 - DNA, 71 bp, Homo sapiens; identical to SEQ ID NO: 39971
  chr3:115752446-115752517
  Hypo

SEQ ID NO: 122219 - DNA, 21 bp, Homo sapiens
  chr3:115789599-115789620
  Hypo
tgtacctgccgggcacggtgg

SEQ ID NO: 122220 - DNA, 281 bp, Homo sapiens; identical to SEQ ID NO: 90018
  chr3:116163708-116163989
  Hyper

SEQ ID NO: 122221 - DNA, 47 bp, Homo sapiens; identical to SEQ ID NO: 90019
  chr3:116583118-116583165
  Hyper

SEQ ID NO: 122222 - DNA, 148 bp, Homo sapiens; identical to SEQ ID NO: 39972
  chr3:116990241-116990389
  Hypo

SEQ ID NO: 122223 - DNA, 164 bp, Homo sapiens; identical to SEQ ID NO: 90025
  chr3:117715479-117715643
  Hyper

SEQ ID NO: 122224 - DNA, 944 bp, Homo sapiens
  chr3:117715763-117716707
  Hyper
cacacacacacacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcgcgctcctgctctcgcctcttccgctcgcgctctctctagtaaaacgcgccgctcctttccctcggtttccctctgggttctcctggttccggcaacccggacagacaagcctcttgccgcacgacggccggatcccagaacagccttgctctcctcttcgggagcgcaagccaggggccgggatggacgctcgtagcccgtgcctggtgtaaacacaccgagcccccttgtccctcgagctctcccgctttcctgcttcctatcctcctctccctcactcccctgcagcttcaactaaatgcgatgtacttaaacaagcagcgccttataggaccgcgaaccgagccgaaagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttggaacatgctagccgcacatcttcatca

SEQ ID NO: 122225 - DNA, 164 bp, Homo sapiens; identical to SEQ ID NO: 90029
  chr3:118864613-118864777
  Hypo

SEQ ID NO: 122226 - DNA, 37 bp, Homo sapiens; identical to SEQ ID NO: 14558
  chr3:118976384-118976421
  Hypo

SEQ ID NO: 122227 - DNA, 30 bp, Homo sapiens; identical to SEQ ID NO: 39974
  chr3:119055204-119055234
  Hypo

SEQ ID NO: 122228 - DNA, 123 bp, Homo sapiens; identical to SEQ ID NO: 90032
  chr3:119298873-119298996
  Hyper

SEQ ID NO: 122229 - DNA, 294 bp, Homo sapiens; identical to SEQ ID NO: 90033
  chr3:119421788-119422082
  Hyper

SEQ ID NO: 122230 - DNA, 173 bp, Homo sapiens; identical to SEQ ID NO: 90034
  chr3:119517629-119517802
  Hypo

SEQ ID NO: 122231 - DNA, 30 bp, Homo sapiens; identical to SEQ ID NO: 90035
  chr3:119771793-119771823
  Hypo

SEQ ID NO: 122232 - DNA, 88 bp, Homo sapiens; identical to SEQ ID NO: 90036
  chr3:119815404-119815492
  Hypo

SEQ ID NO: 122233 - DNA, 180 bp, Homo sapiens; identical to SEQ ID NO: 90037
  chr3:119815732-119815912
  Hypo

SEQ ID NO: 122234 - DNA, 18 bp, Homo sapiens
  chr3:119817451-119817469
  Hypo
aaacgctaggattactgg

SEQ ID NO: 122235 - DNA, 611 bp, Homo sapiens
  chr3:120003742-120004353
  Hyper
tgagagtttctttaccggttccaaacaaactgcccagattctggaaagggagagaaagcccctccccctttccactttcacttaataattaagtgtttgaagttttgtggatccttaaggtcgctgtgctcacctcatcagcgtcggaccgccgagaagcgccaagcccgctgctatgtgcaggacgcccacggtcccccggcgtctcgcgcgttcgcggggctggaaggggcgggaaggggcgggccggggcagagacaggggcccgcgcccatcgccgcgccgggagcctggcgtggaggcggcgggacggcggcgcaggcctctgaggtgtgcgcggggcgccgggcgcctctggccggggcactggctgagccacgcctgcccgcccctccctggcgccgcccgcgtggcgcgcctcgaccctgctctcccgcgagggccgggagggctccgggaccttgcagactccacgcgcctcacggctcctccagctcctcggatctttctccttgcgtcgccgccgagtcccctggggcggccccgcctccggccgtctcctcagagaccttccctggggggcgccttcccctcagcgccccttcccgggc

SEQ ID NO: 122236 - DNA, 611 bp, Homo sapiens
  chr3:120169620-120170231
  Hyper
gaaggcgccgggccccgcgctgacctgggaaacttgctcgggtcccgcaggctcgctccggccgcccaagcacccccggccgcccgaagagtccggcctccgcgccgtgcgccctgcgctcaccgtggtctggtccaggtctcctgggggcgcggggcaggacggcggcagcgagctgtaagcggaggtgggagctccgccgatcgccagcctcggaggaaatgcgacctcccctcgccgccccttaagacctctccttccccgcctgcctgcccccccagctcctccccattctcctcccccttctgctgcagcggcccccgcggctcccgctccccctccttccgacccctgctccggggagcccgcgggagtcctggcgccgccgaacccctctctccgcacggtccctcgtccggcgccccttcggccccctggacgtggagcggaggcagagggggtgtcccgtgggtccctgccacaaaggggtagggggaagggaaaccccaccccgggaggggctgctggctggcggcggcccgggcgggctgcggcggtggccaggtgggcggtgccgtggggggcccgggaaggtccgggactggaacctg

SEQ ID NO: 122237 - DNA, 393 bp, Homo sapiens; identical to SEQ ID NO: 90047
  chr3:120626865-120627258
  Hyper

SEQ ID NO: 122238 - DNA, 693 bp, Homo sapiens; identical to SEQ ID NO: 90048
  chr3:120627318-120628011
  Hyper

SEQ ID NO: 122239 - DNA, 30 bp, Homo sapiens; identical to SEQ ID NO: 28305
  chr3:120628354-120628384
  Hyper

SEQ ID NO: 122240 - DNA, 39 bp, Homo sapiens; identical to SEQ ID NO: 90050
  chr3:121265940-121265979
  Hypo

SEQ ID NO: 122241 - DNA, 28 bp, Homo sapiens
  chr3:121280181-121280209
  Hypo
atgcccagggttggccgggcgtggtggc

SEQ ID NO: 122242 - DNA, 30 bp, Homo sapiens; identical to SEQ ID NO: 39979
  chr3:121438641-121438671
  Hypo

SEQ ID NO: 122243 - DNA, 95 bp, Homo sapiens; identical to SEQ ID NO: 90053
  chr3:121563924-121564019
  Hypo

SEQ ID NO: 122244 - DNA, 269 bp, Homo sapiens; identical to SEQ ID NO: 90054
  chr3:121637808-121638077
  Hypo

SEQ ID NO: 122245 - DNA, 931 bp, Homo sapiens
  chr3:121902727-121903658
  Hyper
aaattgtgccaccctcggcacagagaacgttggtggcgtcgtaagcgccctaagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaccccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcctgctgttggta

SEQ ID NO: 122246 - DNA, 30 bp, Homo sapiens; identical to SEQ ID NO: 39982
  chr3:121980857-121980887
  Hypo

SEQ ID NO: 122247 - DNA, 144 bp, Homo sapiens; identical to SEQ ID NO: 90059
  chr3:122100925-122101069
  Hypo

SEQ ID NO: 122248 - DNA, 26 bp, Homo sapiens
  chr3:122231241-122231267
  Hypo
gtgaagaaacttctacgagaaccact

SEQ ID NO: 122249 - DNA, 35 bp, Homo sapiens; identical to SEQ ID NO: 90061
  chr3:122234211-122234246
  Hypo

SEQ ID NO: 122250 - DNA, 94 bp, Homo sapiens; identical to SEQ ID NO: 90062
  chr3:122234546-122234640
  Hypo

SEQ ID NO: 122251 - DNA, 20 bp, Homo sapiens
  chr3:122279526-122279546
  Hypo
ctggtcgaaatgatttctaa

SEQ ID NO: 122252 - DNA, 367 bp, Homo sapiens
  chr3:122296447-122296814
  Hyper
cagagaaaagaagttcgaggcacaagcctgttgggtggggcgcaactgcagtcccagcgagctgaggatggctgcgccaggcccccttcctgccgctgctctgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatggtgaggagcgcgggggacgggtgcgggaaggggacagcagggctgagcctggggcccgcaagacccagcagcccgagcgggcgcagagaccccacgccacgcacaaccctctct

SEQ ID NO: 122253 - DNA, 22 bp, Homo sapiens
  chr3:122511767-122511789
  Hypo
aactattcgctccttgaagcat

SEQ ID NO: 122254 - DNA, 25 bp, Homo sapiens
  chr3:122573648-122573673
  Hypo
gactcaaaggctgggcgcggtggct

SEQ ID NO: 122255 - DNA, 158 bp, Homo sapiens; identical to SEQ ID NO: 90067
  chr3:122702275-122702433
  Hypo

SEQ ID NO: 122256 - DNA, 338 bp, Homo sapiens; identical to SEQ ID NO: 90068
  chr3:122745310-122745648
  Hyper

SEQ ID NO: 122257 - DNA, 281 bp, Homo sapiens
  chr3:122745900-122746181
  Hyper
gtgctgtttactagccggccctctctgagcctccatctccgcacctctgtccctccgtccctcagcctcactcgtccgtctccttctccaggcctgggtcccgggtccccatcgccgctgcagcccagatgcgccgaccacagccctggcagggcccagtgcaacccggacccaagctggctggcggcgggaacgcagcagcgatgagggctctcaagccgaggtggcagcgggaggcgcggaagccaggggaccccctgtcctcccgcccgcagcctcac

SEQ ID NO: 122258 - DNA, 141 bp, Homo sapiens; identical to SEQ ID NO: 90070
  chr3:122746828-122746969
  Hyper

SEQ ID NO: 122259 - DNA, 30 bp, Homo sapiens; identical to SEQ ID NO: 90071
  chr3:123123913-123123943
  Hypo

SEQ ID NO: 122260 - DNA, 1160 bp, Homo sapiens
  chr3:123166942-123168102
  Hyper
ctccgtcccgcccgccgaggcagccgccgccgccgagccgccgccgccgcccgcagggggcgcccgggtgctgcccccgctggccgcgccccgccgctgccggcggctgccgcgaccgcagtcgtcgccgccgcgctcctgccaggcggacttggagcggaagctgaagccgaagcccccggccagggggtcgtcaccgctcagcggaggatcgtcgtcgtcgtcgctgcgccagcggctggccaggcgctgctgctgctgcggggtcaccgcccccccgggtttcttggtggagccgcgggcagagcccccgggggcatgggggtagccattcgcgcgggaatcggcctcgccccacgcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttgcgggcggtgcctcctcgggccggcagtgcccgggcgcggcgctcgctgattccgcctaagcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggaggtgggatgggaggtggagaggacgggggagggggcgacgggcggagcaacagctccggagccccgggggggagggtcctggagcccgggggggccgttgcccgcatcccccacctc

SEQ ID NO: 122261 - DNA, 367 bp, Homo sapiens
  chr3:123168541-123168908
  Hyper
gcgccatgcacgcttcgggccctgcgccgctccggccgctcgcgccgctcctcccttctcgcccgctcgccgccgccggagagccctccgcatcccctcctcccgctgcctccccgccccccgcgccgcccgggcctcggctcacagccgcgcgaggccgcctccgcccccggcctggccatggccccagcctcggcgccccgcgggcatcctcaggcctggccgcgggcaccccagttccccttcctcacctaaaattctcgctgcgcccctccctccctgggactaggagccgcatccagcctgcggtcccgtcaccagacctgggtggagcgcggtcttcccccgcccccggccagggctccag

SEQ ID NO: 122262 - DNA, 962 bp, Homo sapiens
  chr3:123602612-123603574
  Hyper
gccaggtctggcactcgcgggccgccttccccgccctaccttcccggaatcacatttgggctggaaggaccttcacgtggcacccccttcccagaggccgtcaccgagtcctctagcgagggtctgggagctgggagaagggtccgcttctcctccgcccctcaaatcaaaggcacccccttcggatgattcctagaaaggcaatcgcatcagtgtccccaagcacttcatctccccaaaagaaaactcgtgcagcctggcgtcactggggtcgtctccttacgcccctgactcctcgccgcaccccggggcccctctccattaggggagtcgggaggcacagacggtgggggtcccagcccccacccagaactcccaccctcggagccttgacttccagggcccgcgcctggacaaaagcatggggcgggctcactcacccgcgcggcgaaggcggcccgggagccggggcaccggcgctcggcggggcgccccggccgcaggcgcacagcgcgggctccgagctcgctcagcgccctgctgccgaccgggcggcgcggggagcccgcgaggcgcgtccgggactgggcagggcggggcggggcggggcggggcgggggtgagcgaaccggcgagagagagagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgcacttatcctgcaccgccccagttaactcctcgcaggcggcggtcagcgggctggtactgtcttggtgcgtgtcttagtccta

SEQ ID NO: 122263 - DNA, 188 bp, Homo sapiens; identical to SEQ ID NO: 90079
  chr3:123752385-123752573
  Hyper

SEQ ID NO: 122264 - DNA, 342 bp, Homo sapiens; identical to SEQ ID NO: 90080
  chr3:123752820-123753162
  Hyper

SEQ ID NO: 122265 - DNA, 157 bp, Homo sapiens; identical to SEQ ID NO: 90081
  chr3:124606585-124606742
  Hyper

SEQ ID NO: 122266 - DNA, 312 bp, Homo sapiens; identical to SEQ ID NO: 90082
  chr3:124773620-124773932
  Hyper

SEQ ID NO: 122267 - DNA, 30 bp, Homo sapiens; identical to SEQ ID NO: 90083
  chr3:124875073-124875103
  Hypo

SEQ ID NO: 122268 - DNA, 230 bp, Homo sapiens; identical to SEQ ID NO: 90084
  chr3:125366752-125366982
  Hypo

SEQ ID NO: 122269 - DNA, 28 bp, Homo sapiens
  chr3:125434714-125434742
  Hypo
cgcccctggatatgacgatggacatcgc

SEQ ID NO: 122270 - DNA, 39 bp, Homo sapiens; identical to SEQ ID NO: 14567
  chr3:125785793-125785832
  Hypo

SEQ ID NO: 122271 - DNA, 978 bp, Homo sapiens; identical to SEQ ID NO: 90088
  chr3:125898647-125899625
  Hyper

SEQ ID NO: 122272 - DNA, 66 bp, Homo sapiens; identical to SEQ ID NO: 90089
  chr3:125899826-125899892
  Hyper

SEQ ID NO: 122273 - DNA, 54 bp, Homo sapiens; identical to SEQ ID NO: 90090
  chr3:125931966-125932020
  Hyper

SEQ ID NO: 122274 - DNA, 371 bp, Homo sapiens; identical to SEQ ID NO: 90091
  chr3:125932252-125932623
  Hyper

SEQ ID NO: 122275 - DNA, 231 bp, Homo sapiens; identical to SEQ ID NO: 90093
  chr3:125986509-125986740
  Hyper

SEQ ID NO: 122276 - DNA, 470 bp, Homo sapiens; identical to SEQ ID NO: 90094
  chr3:126075183-126075653
  Hyper

SEQ ID NO: 122277 - DNA, 104 bp, Homo sapiens; identical to SEQ ID NO: 90095
  chr3:126075959-126076063
  Hyper

SEQ ID NO: 122278 - DNA, 114 bp, Homo sapiens; identical to SEQ ID NO: 90096
  chr3:126076540-126076654
  Hyper

SEQ ID NO: 122279 - DNA, 333 bp, Homo sapiens
  chr3:126108034-126108367
  Hyper
accgcgccccgcctgcgagctaggaactgtggggacccggcagcgggcgagcgagcccaggtcgcggcagcactgcctgcgcggtcgtcttgacgcctgaccagggccggttttcaacttgtttacaagcctgcgtcaccgggaacctttcaccgccgcctgggacaaaaggttcctctttgtaagtcccttctgggcagaaaggggattcgccgcccggcgcgctgacggtgcggggcgccacgccgtggcggatgcggacagcgcgcggccggttcgcccgtctgccccctagcgccctgctcttcccgccgagcgcgtagtctgcccata

SEQ ID NO: 122280 - DNA, 500 bp, Homo sapiens
  chr3:126113459-126113959
  Hyper
cttcagtgcttggcacgtggcgaataaaccaatcaggatgaaaggagccaacccaagtgcggagtgttgaacctcagaggaagaaacccgcgttcaccaggcccaggcctgggccaggcgctgtcctggcggcgtcagggaggacatcgtgcccagagctcggacccagcagcccggccccgcgccctccctgtcccgcggcccgcaggcccagccctcaagcgcccagcctccgcggcctttgtggcgtcacagccagcctgaagaatggttgccttggagacgtaaacccaagagccctgctcctggagctgagaactgcagcgcggaggcttcggagcgagccggggcagtcggggtcggtgggtgcgctcgcggtccggggagagggggcgcgcggggtccgtgagggcgcgtgggggcggcggcaggggtgcgaaaccagggcccgaggggcgcgcgtggccgggagcggacttgcaaggcgccttccaaggctg

SEQ ID NO: 122281 - DNA, 126 bp, Homo sapiens; identical to SEQ ID NO: 90101
  chr3:126134579-126134705
  Hypo

SEQ ID NO: 122282 - DNA, 51 bp, Homo sapiens; identical to SEQ ID NO: 90102
  chr3:126138969-126139020
  Hypo

SEQ ID NO: 122283 - DNA, 167 bp, Homo sapiens; identical to SEQ ID NO: 39993
  chr3:126195886-126196053
  Hypo

SEQ ID NO: 122284 - DNA, 30 bp, Homo sapiens; identical to SEQ ID NO: 90104
  chr3:126228677-126228707
  Hypo

SEQ ID NO: 122285 - DNA, 197 bp, Homo sapiens; identical to SEQ ID NO: 90105
  chr3:126242861-126243058
  Hyper

SEQ ID NO: 122286 - DNA, 76 bp, Homo sapiens; identical to SEQ ID NO: 90106
  chr3:126243385-126243461
  Hyper

SEQ ID NO: 122287 - DNA, 34 bp, Homo sapiens; identical to SEQ ID NO: 90107
  chr3:126271443-126271477
  Hypo

SEQ ID NO: 122288 - DNA, 69 bp, Homo sapiens; identical to SEQ ID NO: 90108
  chr3:126373464-126373533
  Hyper

SEQ ID NO: 122289 - DNA, 72 bp, Homo sapiens; identical to SEQ ID NO: 28334
  chr3:126373752-126373824
  Hyper

SEQ ID NO: 122290 - DNA, 21 bp, Homo sapiens
  chr3:126374476-126374497
  Hypo
agtgactgagttagccggtca

SEQ ID NO: 122291 - DNA, 250 bp, Homo sapiens; identical to SEQ ID NO: 90112
  chr3:126756255-126756505
  Hypo

SEQ ID NO: 122292 - DNA, 30 bp, Homo sapiens; identical to SEQ ID NO: 90113
  chr3:126848530-126848560
  Hypo

SEQ ID NO: 122293 - DNA, 30 bp, Homo sapiens; identical to SEQ ID NO: 90114
  chr3:126853082-126853112
  Hypo

SEQ ID NO: 122294 - DNA, 89 bp, Homo sapiens; identical to SEQ ID NO: 90115
  chr3:126854032-126854121
  Hypo

SEQ ID NO: 122295 - DNA, 422 bp, Homo sapiens
  chr3:126854425-126854847
  Hyper
tatcgcgcggacggtcgctcttcttcacgtaattggagaaacttttcccattacccgctgtctctgcgaggcggctctcccgcccccgcaccctccccgcggcccctctgccgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctccaggccatcgcagcccccggccctgccacgcaccggcgcagcccctgcactcgggcggccctgcctcggcgggatgagttcgtccgaggtgcatacaagatgagaaacagagcgccgggttgcagtgccaggcaccgagctgggctcccc

SEQ ID NO: 122296 - DNA, 86 bp, Homo sapiens; identical to SEQ ID NO: 90118
  chr3:127176157-127176243
  Hyper

SEQ ID NO: 122297 - DNA, 30 bp, Homo sapiens; identical to SEQ ID NO: 90119
  chr3:127177694-127177724
  Hyper

SEQ ID NO: 122298 - DNA, 30 bp, Homo sapiens; identical to SEQ ID NO: 90120
  chr3:127258523-127258553
  Hypo

SEQ ID NO: 122299 - DNA, 46 bp, Homo sapiens; identical to SEQ ID NO: 90121
  chr3:127268781-127268827
  Hypo

SEQ ID NO: 122300 - DNA, 233 bp, Homo sapiens; identical to SEQ ID NO: 90122
  chr3:127318268-127318501
  Hypo

SEQ ID NO: 122301 - DNA, 263 bp, Homo sapiens; identical to SEQ ID NO: 90123
  chr3:127347860-127348123
  Hyper

SEQ ID NO: 122302 - DNA, 146 bp, Homo sapiens; identical to SEQ ID NO: 90124
  chr3:127390301-127390447
  Hypo

SEQ ID NO: 122303 - DNA, 77 bp, Homo sapiens; identical to SEQ ID NO: 39994
  chr3:127394832-127394909
  Hypo

SEQ ID NO: 122304 - DNA, 85 bp, Homo sapiens; identical to SEQ ID NO: 90126
  chr3:127395891-127395976
  Hypo

SEQ ID NO: 122305 - DNA, 30 bp, Homo sapiens; identical to SEQ ID NO: 90127
  chr3:127505428-127505458
  Hypo

SEQ ID NO: 122306 - DNA, 68 bp, Homo sapiens; identical to SEQ ID NO: 39996
  chr3:127534964-127535032
  Hypo

SEQ ID NO: 122307 - DNA, 136 bp, Homo sapiens; identical to SEQ ID NO: 90129
  chr3:127536709-127536845
  Hypo

SEQ ID NO: 122308 - DNA, 30 bp, Homo sapiens; identical to SEQ ID NO: 90130
  chr3:127570998-127571028
  Hypo

SEQ ID NO: 122309 - DNA, 403 bp, Homo sapiens
  chr3:127633909-127634312
  Hyper
agtgtaaaagactaacgggaacaccggcatttttcaaagctcgatttccaaacctcctttaaacacttgtccccatcccctccccgcaggccttcagtcgctctggcacgcgggccagcgcgggaacactctgcgcaggcgcacagcgttccgcgggggacgctcagtagggtacgggacgcgcgcggggagaccctgtgcagcgacaccggggctgtagtcgccgtctggaaccagcgcgggaataggtgcgcaggcgcacagtggctggagggcagcggcggcgtggtctcgggccacttccaagcagagggcagcacctgtcccctcggaggcgctgccagcgccctccctcctcctccgcagggcgcgggacctctatttatatcgcccagccagcaca

SEQ ID NO: 122310 - DNA, 52 bp, Homo sapiens; identical to SEQ ID NO: 39998
  chr3:127637657-127637709
  Hypo

SEQ ID NO: 122311 - DNA, 43 bp, Homo sapiens; identical to SEQ ID NO: 90134
  chr3:127731040-127731083
  Hypo

SEQ ID NO: 122312 - DNA, 467 bp, Homo sapiens; identical to SEQ ID NO: 90135
  chr3:127794393-127794860
  Hyper

SEQ ID NO: 122313 - DNA, 30 bp, Homo sapiens
  chr3:127795148-127795178
  Hyper
cccaacagcatgacccgacccagggacgaa

SEQ ID NO: 122314 - DNA, 90 bp, Homo sapiens; identical to SEQ ID NO: 90137
  chr3:128102325-128102415
  Hypo

SEQ ID NO: 122315 - DNA, 38 bp, Homo sapiens; identical to SEQ ID NO: 90138
  chr3:128145121-128145159
  Hyper

SEQ ID NO: 122316 - DNA, 33 bp, Homo sapiens; identical to SEQ ID NO: 90139
  chr3:128152132-128152165
  Hyper

SEQ ID NO: 122317 - DNA, 383 bp, Homo sapiens
  chr3:128202325-128202708
  Hyper
cgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtct

SEQ ID NO: 122318 - DNA, 30 bp, Homo sapiens; identical to SEQ ID NO: 90141
  chr3:128205103-128205133
  Hyper

SEQ ID NO: 122319 - DNA, 1961 bp, Homo sapiens; identical to SEQ ID NO: 90142
  chr3:128205402-128207363
  Hyper

SEQ ID NO: 122320 - DNA, 1686 bp, Homo sapiens
  chr3:128207713-128209399
  Hyper
ggggagacggaggctcgaagggagccccgggccgaggagggaggtccaggacaaaggcattttgggggacctagacaggtgccgagtactggggggactcaacagcgtcctccagccctcttccctgttgggcccgaggctcccggggtagatgtccagagggcccccaggtgggtcgggggcaggaggagggctggggtcccggccacccccgggagagtgggggaggggcggcgggattgacagtcggtaattgggtaactggaggcggcttctccggccgggcggccccgccaccgcgacgccgagcccctgacgtcacccgattcgccaggaaatgaactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgaccgaagcctccacctcggttgcaggtcctgcgtaggatgcgggactgctgcatt

SEQ ID NO: 122321 - DNA, 33 bp, Homo sapiens
  chr3:128216680-128216713
  Hyper
ccagagtctattatacggcgggattagctcatc

SEQ ID NO: 122322 - DNA, 838 bp, Homo sapiens
  chr3:128273832-128274670
  Hyper
cctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggagtcccgggaggggcagcggggacggggaccctgaggcccaggggattgggctcaggggccggattcaggatgctttccgcgcagagccagccgcagaaggggcatgggaaagagcctcatctacgcacgagaaaaccgggccgagagtcaagagccaaggcggggctgccgttccagggcgcgagccgggccgtcccccacctcgatcctgtgcgccctgcctcgggcggccagggtgcgcgcggcggccgcgggcgctgcggagagaccggcggaggccggggcacccggcgtgtttttcaggaaggaagccttcgctcctgtaacaggctggggcttggcccggcccgcggccgccccgccaggaagcgccccgtccgccccctcggggcgcgtccgcggcaggcacttttgaggacaggaaggggagaggtgacctgagcatccacgcagctgtggcattcggggacgggccgaggactgggtttcttgccatcctcagcgctgggggtgactccaagcccccgggtgggggtggggagtggccgggcatggcgcccggctccacaatgcatcgccttacccggccggaattcctgcaggacgctttgttctcagatggcagcgctgctagagccatcggacctgtgaggggggggcgcccggggcaggccagag

SEQ ID NO: 122323 - DNA, 30 bp, Homo sapiens; identical to SEQ ID NO: 90147
  chr3:128279869-128279899
  Hypo

SEQ ID NO: 122324 - DNA, 30 bp, Homo sapiens; identical to SEQ ID NO: 90148
  chr3:128297409-128297439
  Hypo

SEQ ID NO: 122325 - DNA, 95 bp, Homo sapiens; identical to SEQ ID NO: 90149
  chr3:128326970-128327065
  Hyper

SEQ ID NO: 122326 - DNA, 141 bp, Homo sapiens; identical to SEQ ID NO: 90150
  chr3:128327456-128327597
  Hyper

SEQ ID NO: 122327 - DNA, 35 bp, Homo sapiens; identical to SEQ ID NO: 90151
  chr3:128343672-128343707
  Hypo

SEQ ID NO: 122328 - DNA, 30 bp, Homo sapiens; identical to SEQ ID NO: 39999
  chr3:128346689-128346719
  Hypo

SEQ ID NO: 122329 - DNA, 573 bp, Homo sapiens; identical to SEQ ID NO: 90154
  chr3:128417048-128417621
  Hyper

SEQ ID NO: 122330 - DNA, 81 bp, Homo sapiens; identical to SEQ ID NO: 90156
  chr3:128599545-128599626
  Hypo

SEQ ID NO: 122331 - DNA, 34 bp, Homo sapiens; identical to SEQ ID NO: 40001
  chr3:128611894-128611928
  Hypo

SEQ ID NO: 122332 - DNA, 30 bp, Homo sapiens; identical to SEQ ID NO: 90158
  chr3:128653973-128654003
  Hypo

SEQ ID NO: 122333 - DNA, 1254 bp, Homo sapiens
  chr3:128720061-128721315
  Hyper
tcggagcgaactctccgcgccaggcgggcggggcggagggaggagggagttgagagtggacggccgggagtgggaggaaaagcgcagacgccaggaacgccccgtgagtgaggagaggagagcgtgggagtcacgcggagaagccagacccagacgccgaccgggcactggtggcgctgccggggtcccgggggttcctggaccccctaccccaggcccctccaaagcaactggggtaaaccagacgcactgtgaggccagcgcagctgctggacacggtccccggcgccgctccaaccagaccgcgaccgctaagcccctcctttcgagaaactctggggccgcccctggaagtggcggggcgaagggaccggaggagggaccggaggagcgaggcgcgcggcgcagcgatggagccggtcagcacgggcgcggaggccggcatggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgccggagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtgcgcgccggccacgaagggagggtggtaacgcccgggagagggctcgaactaaaagctggctggctgcggagcccgacaggacagagtcagaggaaggggagacagagggcagccccacaccatcccactccgcatcagcacactt

SEQ ID NO: 122334 - DNA, 78 bp, Homo sapiens; identical to SEQ ID NO: 90166
  chr3:128733875-128733953
  Hypo

SEQ ID NO: 122335 - DNA, 86 bp, Homo sapiens; identical to SEQ ID NO: 90167
  chr3:128746467-128746553
  Hypo

SEQ ID NO: 122336 - DNA, 417 bp, Homo sapiens
  chr3:128764489-128764906
  Hyper
aactacaatttgctccggcggaagtgaggagcaggcctgggccctaagggccgggcctcgaccccccgcaggtccccgcggtcccggtcccccgcccgggacatctgatggaccgagccgcgcccccgcggagcaccacttcggaggcctgagagcggcgaccgggcagggcgtggcctacatcccggagcctcgcgccttctcctgcgccgacttctgcagggcctccggctgctcgagccgccctgcgctgctcccgcgcctgcacccgaggctggggcagcggcggcgctgggtgacgccggagggggcgcccgacttgaaccaactgcggcggacccgggagccggggtccaggaatacagcccgaaccccaagaatacaacccgaaccccaagagtacgtgcccctcagaga

SEQ ID NO: 122337 - DNA, 68 bp, Homo sapiens; identical to SEQ ID NO: 90170
  chr3:128765883-128765951
  Hypo

SEQ ID NO: 122338 - DNA, 30 bp, Homo sapiens; identical to SEQ ID NO: 90171
  chr3:128766505-128766535
  Hypo

SEQ ID NO: 122339 - DNA, 30 bp, Homo sapiens; identical to SEQ ID NO: 90172
  chr3:128785960-128785990
  Hypo

SEQ ID NO: 122340 - DNA, 41 bp, Homo sapiens; identical to SEQ ID NO: 40003
  chr3:128790177-128790218
  Hypo

SEQ ID NO: 122341 - DNA, 30 bp, Homo sapiens; identical to SEQ ID NO: 90174
  chr3:129047343-129047373
  Hypo

SEQ ID NO: 122342 - DNA, 33 bp, Homo sapiens; identical to SEQ ID NO: 90175
  chr3:129047805-129047838
  Hypo

SEQ ID NO: 122343 - DNA, 32 bp, Homo sapiens; identical to SEQ ID NO: 90176
  chr3:129048078-129048110
  Hypo

SEQ ID NO: 122344 - DNA, 178 bp, Homo sapiens; identical to SEQ ID NO: 90177
  chr3:129085333-129085511
  Hypo

SEQ ID NO: 122345 - DNA, 16 bp, Homo sapiens
  chr3:129090469-129090485
  Hypo
acgttcatgcagtcct

SEQ ID NO: 122346 - DNA, 30 bp, Homo sapiens; identical to SEQ ID NO: 90179
  chr3:129103767-129103797
  Hypo

SEQ ID NO: 122347 - DNA, 30 bp, Homo sapiens; identical to SEQ ID NO: 90182
  chr3:129221988-129222018
  Hypo

SEQ ID NO: 122348 - DNA, 30 bp, Homo sapiens; identical to SEQ ID NO: 90183
  chr3:129240328-129240358
  Hypo

SEQ ID NO: 122349 - DNA, 30 bp, Homo sapiens; identical to SEQ ID NO: 90184
  chr3:129240597-129240627
  Hypo

SEQ ID NO: 122350 - DNA, 30 bp, Homo sapiens; identical to SEQ ID NO: 90185
  chr3:129324172-129324202
  Hyper

SEQ ID NO: 122351 - DNA, 92 bp, Homo sapiens; identical to SEQ ID NO: 28362
  chr3:129324567-129324659
  Hyper

SEQ ID NO: 122352 - DNA, 152 bp, Homo sapiens; identical to SEQ ID NO: 90187
  chr3:129324893-129325045
  Hyper

SEQ ID NO: 122353 - DNA, 126 bp, Homo sapiens; identical to SEQ ID NO: 90188
  chr3:129346438-129346564
  Hyper

SEQ ID NO: 122354 - DNA, 163 bp, Homo sapiens; identical to SEQ ID NO: 90189
  chr3:129626946-129627109
  Hypo

SEQ ID NO: 122355 - DNA, 1228 bp, Homo sapiens
  chr3:129693071-129694299
  Hyper
ccccattctctctctctctctctttctctctctctctctcttgctctactctcgcccgtctgcgttctacattggttctgcggccgtgtccctttcgtgtgtgtctgccctgtgtttctccgtcgtctccgtgtggatctcggtctttgtctcgccctctagctctctcgtgcgcctgtgtttaatcgtgcgcttctctcaatctctctgtccctccctttgccccctacacgcgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcaggtaaccgccccaacccctctccttccgcagacggtgtccgggagcactggaaagggagccctctcggcccgccctcaccttcggttctctgagagcttcctggagaacagggccggtgcacaggcgggcgctgtgctcgcacccccgggtcctccccgagcgcaggccggggacccgacgggaggcacggcgcgggcacatcggaggctctcgctgctgggcactcaggtcgccagagtccgcagcgcggggtgggagctccgcggcaccccctgcctgggtgccgccggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagttagaacgtggcgatggggacctttgggggagtcttggcggggacgcaaccgttagcgtcgcggctgtgcctggcgctgcaatctcaat

SEQ ID NO: 122356 - DNA, 60 bp, Homo sapiens
  chr3:129694504-129694564
  Hyper
gctcccgcccctgcacgaggggcagtggtcctgcttctgggagggcggttgaactgtgcg

SEQ ID NO: 122357 - DNA, 71 bp, Homo sapiens; identical to SEQ ID NO: 90194
  chr3:129983032-129983103
  Hypo

SEQ ID NO: 122358 - DNA, 397 bp, Homo sapiens
  chr3:130064451-130064848
  Hyper
agttcatttggcagccggcggcttctctgaaacaaagccagcaaacagctggagcgtctctggacactcacattaaaacttgtgaagagttaaaagccccagggaagagccaggccaagggcacgggtcagcgccggcttaaaagaccctctcagggcacgaggcgttcgctgcgggaatccacctgcagctgtgcggcgcggaccagggcgtgcggcgcggaccagggcttccggcgcgcgctctatccaactgcgccgcgggcgcccgagaggcgcgcgtttactgcgctcaggagctcggtgcagcctcttctggagagttgggggcggtttccagggtccggagtgtcccctgaccccgggaaagctgggtaagtatgcggtgcggggacttg

SEQ ID NO: 122359 - DNA, 88 bp, Homo sapiens; identical to SEQ ID NO: 90200
  chr3:130235499-130235587
  Hyper

SEQ ID NO: 122360 - DNA, 410 bp, Homo sapiens
  chr3:130235793-130236203
  Hyper
ctttcttttctcccacggtcgggaccttagggtaggagtttcaagaggggagaagccggtggagcagtaacagccttcataatgtctccagtcccgcttccgtcacctccctaaggctgcgcccccctcctgggggacgtgcgctgggcccggggccgccggggcggggaagggtcgggcccggggcggggagaagcgtttatatgtcggcgaggggcgtgggagctgccacccgcttgcctgcgggacaccggagtcaagaggctgcccacgccgctgcctgtccgttccacggttccgaggtctccaccgtctccccgcgcgccgcaggcggcaccaaactctgcgctccccgcggtgcgccctgcccgcgcagtgcgcgtccagaggaaatccgccccgggctttcg

SEQ ID NO: 122361 - DNA, 34 bp, Homo sapiens; identical to SEQ ID NO: 90204
  chr3:130323372-130323406
  Hypo

SEQ ID NO: 122362 - DNA, 28 bp, Homo sapiens
  chr3:130341407-130341435
  Hypo
atacagactttgagccgggcgtggtggc

SEQ ID NO: 122363 - DNA, 227 bp, Homo sapiens; identical to SEQ ID NO: 90206
  chr3:130474409-130474636
  Hypo

SEQ ID NO: 122364 - DNA, 35 bp, Homo sapiens; identical to SEQ ID NO: 90207
  chr3:130492203-130492238
  Hypo

SEQ ID NO: 122365 - DNA, 39 bp, Homo sapiens; identical to SEQ ID NO: 40006
  chr3:130519901-130519940
  Hypo

SEQ ID NO: 122366 - DNA, 33 bp, Homo sapiens; identical to SEQ ID NO: 90212
  chr3:131081158-131081191
  Hyper

SEQ ID NO: 122367 - DNA, 40 bp, Homo sapiens; identical to SEQ ID NO: 90213
  chr3:131447460-131447500
  Hypo

SEQ ID NO: 122368 - DNA, 21 bp, Homo sapiens
  chr3:131593216-131593237
  Hypo
ccaccgcgcctggcctcagtt

SEQ ID NO: 122369 - DNA, 198 bp, Homo sapiens; identical to SEQ ID NO: 90215
  chr3:131752588-131752786
  Hyper

SEQ ID NO: 122370 - DNA, 101 bp, Homo sapiens; identical to SEQ ID NO: 90216
  chr3:131753055-131753156
  Hyper

SEQ ID NO: 122371 - DNA, 180 bp, Homo sapiens; identical to SEQ ID NO: 90217
  chr3:131753972-131754152
  Hyper

SEQ ID NO: 122372 - DNA, 256 bp, Homo sapiens; identical to SEQ ID NO: 90219
  chr3:132440027-132440283
  Hypo

SEQ ID NO: 122373 - DNA, 30 bp, Homo sapiens; identical to SEQ ID NO: 90220
  chr3:132502767-132502797
  Hypo

SEQ ID NO: 122374 - DNA, 165 bp, Homo sapiens; identical to SEQ ID NO: 90221
  chr3:132756312-132756477
  Hypo

SEQ ID NO: 122375 - DNA, 938 bp, Homo sapiens
  chr3:132756970-132757908
  Hyper
gagaccctttgtgcccgcctcgcacccgctctgctaggtagcaaccgaacccccagagacatcggagcgggcgctgccgagggcaatttggtgattggctggtctcaccacgtgaccggcgctgagccttccgtgcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtgacgggtctgcccgaggggagttgcccacctggcagccctgcctccgcctttgtttcccgcctggagggttgctggcatgaaccccctccccaggtggagggtgcgggtgatggggcgcgggcgtcaggagcgctggacctgggctggggccgaggaggaggtggctttaatgcagggggacctgtcacatggggaaacgaagaagaagaaatgtagtgtcactttggccagcccgagggactcgaactaatcctgcggccgcgagcggagccgaattcctagcgcagctgtgcgaagagccctcctgcctaggtgccggcggcctcgccggggacggagcctccgtgctgcccgggaggttgctctgccggctggacctggcggttttcaccccagagttgcagcgaaattgaacgctttgagcctgct

SEQ ID NO: 122376 - DNA, 30 bp, Homo sapiens; identical to SEQ ID NO: 40007
  chr3:133101687-133101717
  Hypo

SEQ ID NO: 122377 - DNA, 135 bp, Homo sapiens; identical to SEQ ID NO: 90225
  chr3:133217920-133218055
  Hypo

SEQ ID NO: 122378 - DNA, 22 bp, Homo sapiens
  chr3:133332636-133332658
  Hypo
tttttttttttgagacggagtc

SEQ ID NO: 122379 - DNA, 30 bp, Homo sapiens; identical to SEQ ID NO: 90231
  chr3:133545624-133545654
  Hypo

SEQ ID NO: 122380 - DNA, 42 bp, Homo sapiens; identical to SEQ ID NO: 90232
  chr3:133556962-133557004
  Hypo

SEQ ID NO: 122381 - DNA, 30 bp, Homo sapiens; identical to SEQ ID NO: 90233
  chr3:133560299-133560329
  Hypo

SEQ ID NO: 122382 - DNA, 294 bp, Homo sapiens
  chr3:133613668-133613962
  Hyper
agcagagacaggtgtcgctcttttctccccggtggctgtttgtcccacgccctggacgtgccctttcgcatggttcccagcagggtccgcagggaacacccctccagtgcagcggagtgaggcccggccagaccccagcttcgcttcgttctccaaggggggcgcccgtcgctctccccacccccgccagcacccagccacctgcgcggtcgcccgcagccggtgccgcagtgtgagctagccagcgagcccggttccttcacgccctggccagcgccgcggagccagccgccg

SEQ ID NO: 122383 - DNA, 66 bp, Homo sapiens; identical to SEQ ID NO: 90238
  chr3:133614601-133614667
  Hyper

SEQ ID NO: 122384 - DNA, 114 bp, Homo sapiens; identical to SEQ ID NO: 90239
  chr3:133615019-133615133
  Hyper

SEQ ID NO: 122385 - DNA, 160 bp, Homo sapiens; identical to SEQ ID NO: 90240
  chr3:133646291-133646451
  Hyper

SEQ ID NO: 122386 - DNA, 98 bp, Homo sapiens; identical to SEQ ID NO: 90243
  chr3:133748007-133748105
  Hyper

SEQ ID NO: 122387 - DNA, 46 bp, Homo sapiens; identical to SEQ ID NO: 90244
  chr3:133748648-133748694
  Hyper

SEQ ID NO: 122388 - DNA, 376 bp, Homo sapiens; identical to SEQ ID NO: 90245
  chr3:134032195-134032571
  Hyper

SEQ ID NO: 122389 - DNA, 79 bp, Homo sapiens; identical to SEQ ID NO: 90246
  chr3:134092564-134092643
  Hyper

SEQ ID NO: 122390 - DNA, 30 bp, Homo sapiens; identical to SEQ ID NO: 90247
  chr3:134093118-134093148
  Hyper

SEQ ID NO: 122391 - DNA, 578 bp, Homo sapiens; identical to SEQ ID NO: 90248
  chr3:134125220-134125798
  Hyper

SEQ ID NO: 122392 - DNA, 37 bp, Homo sapiens; identical to SEQ ID NO: 90249
  chr3:134202929-134202966
  Hypo

SEQ ID NO: 122393 - DNA, 220 bp, Homo sapiens; identical to SEQ ID NO: 40008
  chr3:134320427-134320647
  Hypo

SEQ ID NO: 122394 - DNA, 747 bp, Homo sapiens
  chr3:134369449-134370196
  Hyper
aaactggggcaatcacggggctgcgcgttgccacgggactgcgcgttgccacgggacgccggtgccactgcggggaagcgacggcagccatgggggagagggtcgggttcgctgacctcgttcgggggagcaatgggcgccccccggcgggcaggcccttgtggcaaggaggccaaggtgccgggggacccggggacccgggtcgggcgcgcgttacctcctccgcgctgcagcagcgagctcgggttcgcctgctggtctgagagcgtaccctgtgcggcgcgccgcttctccgagtgcacgatcagcagcatgtcgatagatacagcgttgatgtccttcttcagctccatgatgccgcctcctttccgacctgggcgccgcggccgcacgctaggctgcttgcgctgcaaatggccccgtgcgcgcagctgccccacacgggagagggcgagggcgcggaagagggcgctcccccgccgctggagccgcagggcgctgcttttcgctgactctgccaaacacgccattagggcccgcctgggagggcgctaccctaatgaagcggctctaagtcacctttgaaaggaaatccccgggcccaagccttgacctgcaccggggccatagtcagcaggggcggccggtccagagcctccctccctgcgcccctgcctcccgcccggtgcacttgaagcgctggtcctgggctccagggcttctctggctgagcgctgcctcatcccc

SEQ ID NO: 122395 - DNA, 718 bp, Homo sapiens; identical to SEQ ID NO: 90257
  chr3:134514070-134514788
  Hyper

SEQ ID NO: 122396 - DNA, 1288 bp, Homo sapiens; identical to SEQ ID NO: 90258
  chr3:134515035-134516323
  Hyper

SEQ ID NO: 122397 - DNA, 157 bp, Homo sapiens; identical to SEQ ID NO: 90259
  chr3:134565144-134565301
  Hypo

SEQ ID NO: 122398 - DNA, 30 bp, Homo sapiens; identical to SEQ ID NO: 40009
  chr3:134624264-134624294
  Hypo

SEQ ID NO: 122399 - DNA, 30 bp, Homo sapiens; identical to SEQ ID NO: 90261
  chr3:134967156-134967186
  Hypo

SEQ ID NO: 122400 - DNA, 177 bp, Homo sapiens; identical to SEQ ID NO: 90262
  chr3:135172075-135172252
  Hypo

SEQ ID NO: 122401 - DNA, 26 bp, Homo sapiens
  chr3:135298460-135298486
  Hypo
aaggggaaattaggccgggcgcagtg

SEQ ID NO: 122402 - DNA, 30 bp, Homo sapiens; identical to SEQ ID NO: 90264
  chr3:135309812-135309842
  Hypo

SEQ ID NO: 122403 - DNA, 30 bp, Homo sapiens; identical to SEQ ID NO: 90266
  chr3:135627324-135627354
  Hypo

SEQ ID NO: 122404 - DNA, 538 bp, Homo sapiens; identical to SEQ ID NO: 90267
  chr3:135684904-135685442
  Hyper

SEQ ID NO: 122405 - DNA, 56 bp, Homo sapiens; identical to SEQ ID NO: 90270
  chr3:135996415-135996471
  Hypo

SEQ ID NO: 122406 - DNA, 135 bp, Homo sapiens; identical to SEQ ID NO: 90272
  chr3:136254713-136254848
  Hypo

SEQ ID NO: 122407 - DNA, 38 bp, Homo sapiens; identical to SEQ ID NO: 90273
  chr3:136366118-136366156
  Hypo

SEQ ID NO: 122408 - DNA, 588 bp, Homo sapiens; identical to SEQ ID NO: 90274
  chr3:136537591-136538179
  Hyper

SEQ ID NO: 122409 - DNA, 215 bp, Homo sapiens; identical to SEQ ID NO: 90275
  chr3:136538621-136538836
  Hyper

SEQ ID NO: 122410 - DNA, 120 bp, Homo sapiens; identical to SEQ ID NO: 40010
  chr3:136582940-136583060
  Hypo

SEQ ID NO: 122411 - DNA, 373 bp, Homo sapiens; identical to SEQ ID NO: 90277
  chr3:136751376-136751749
  Hyper

SEQ ID NO: 122412 - DNA, 16 bp, Homo sapiens
  chr3:136916207-136916223
  Hypo
tgggcagaggccgggc

SEQ ID NO: 122413 - DNA, 1634 bp, Homo sapiens; identical to SEQ ID NO: 90282
  chr3:137479130-137480764
  Hyper

SEQ ID NO: 122414 - DNA, 227 bp, Homo sapiens; identical to SEQ ID NO: 90283
  chr3:137481120-137481347
  Hyper

SEQ ID NO: 122415 - DNA, 393 bp, Homo sapiens
  chr3:137481774-137482167
  Hyper
gggtgagaagttccacgcgtctttctaattttaggaaggggaagcaaagtcttctcctcaaacttgatacactacatgctagagaaagatcctcccttccggcctcctcattccctgtcaccctcccccactcctagcccctcggagccaacggagccttgcgcgtttctggccggtcctcccaagagagaatggtgcaaaagccaataagcctggaacacacgcaggtcccgccgggcctgggacaatggtttccatttaataaatatttcccccaagggcatttcacatcgggcaggcaattattcaaaggaaacaggcgcgcaggttggctctgcgggttatttcgtcctctttacccgaagaatgctcatttgacgcaagaaacgagtc

SEQ ID NO: 122416 - DNA, 30 bp, Homo sapiens; identical to SEQ ID NO: 28397
  chr3:137483214-137483244
  Hyper

SEQ ID NO: 122417 - DNA, 1039 bp, Homo sapiens
  chr3:137483649-137484688
  Hyper
caagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcggcgccctactccctgctggaccccgcgcagtttagctcgagcgccatccagaagatgggcgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtcctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 122418 - DNA, 548 bp, Homo sapiens; identical to SEQ ID NO: 28401
  chr3:137485061-137485609
  Hyper

SEQ ID NO: 122419 - DNA, 441 bp, Homo sapiens; identical to SEQ ID NO: 90290
  chr3:137485869-137486310
  Hyper

SEQ ID NO: 122420 - DNA, 304 bp, Homo sapiens; identical to SEQ ID NO: 28403
  chr3:137486516-137486820
  Hyper

SEQ ID NO: 122421 - DNA, 74 bp, Homo sapiens
  chr3:137487025-137487099
  Hyper
ggctggaaaggggcacgtggcgagtgcgagggcaaagtgcgaggggcaaaggcctcggacggtggctgaagctg

SEQ ID NO: 122422 - DNA, 731 bp, Homo sapiens
  chr3:137487303-137488034
  Hyper
ttggccatcacacttcgtttccttccttctcagactggccttccccagccatctgccctccttagacctggtcccaacctctgcccccacccccatccccgcaagagcctgcctcagctttgcctccgtcgccccgagggctgcggagcgtccgccgaggtgcgcggccgcgactcgccctaacaaacagccaaaatcctgctcgtcacgccgctgacaggggccgattactgactttgaagtcaggcgcagacaaaaagaaatcccctggggggtgtgggggggcagcagtccctgtcaaacctgtttgctcacaactgtctctttctttcaagaaaatcattaaagcaaacctgtagggagaggagcgccccgcccgcccggagtggagaagagccgcttctcccgagcgcgcgtcgcgcagcaaagagcagccaagagttgccctggacagactcctggcatccggagaacctgaactccggcgctgcaaggggcgcccgtggccctgcaggaggaggttctgcagatccctctgcgttaggcacgcgtccggtagccagggagccccagacttctctcgcttagcaacctgggcctccttcgagcggggttggcagggagggcccggacctctcgcctgaggctcccattgcttccccgggacccttctccccgccaaaagtgacccaaatacatgccgcgttcagcgccgtcgctcctctgctggg

SEQ ID NO: 122423 - DNA, 245 bp, Homo sapiens; identical to SEQ ID NO: 28408
  chr3:137488337-137488582
  Hyper

SEQ ID NO: 122424 - DNA, 2371 bp, Homo sapiens
  chr3:137488807-137491178
  Hyper
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctacaaagtggagaagttgctctactctggagggcagtggccttttccaaacttttccacttaggtccgtaagaaaagcaattcatacacgatcagcgctttcggtgcgaggatggaaagaaacttcagaaaaactctcgccagacaacccggcagcacttggccccggaacagagaggagagaaagacctgaccgccgcactcagggccacccgccgcactaagtttgagggttccctctgcctccaggcctctgtcgcccgagctcaggctctcctaggtgcttcagggccgggctgcactcgagccccgaggaggccctgctagcgctagcgcggcggtgataaccgagggaggtgggtgagaggtgcggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatcccatctttcttatctctcgaagactcctttcaggctgagatcagagagggagggaaaaagaagagagaatcattgttcttctttttttaatttaatataccaagccaccagctcaggtcatttatatgcttaatttagtgataaaagtcaataagcggaatcacagggtt

SEQ ID NO: 122425 - DNA, 17 bp, Homo sapiens
  chr3:137561189-137561206
  Hypo
agtctagctattggccg

SEQ ID NO: 122426 - DNA, 374 bp, Homo sapiens
  chr3:137717678-137718052
  Hypo
cgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccaggtaagggccaggtgtctggctggctggagggagagattggaggtggagaggaaactgcaggctctgtctgggcaccacgacagggactgctggggagggaggaactgcgattcgtgtttgac

SEQ ID NO: 122427 - DNA, 21 bp, Homo sapiens
  chr3:137945120-137945141
  Hypo
ccactgcgcccagcctaacat

SEQ ID NO: 122428 - DNA, 120 bp, Homo sapiens; identical to SEQ ID NO: 90302
  chr3:138058967-138059087
  Hypo

SEQ ID NO: 122429 - DNA, 234 bp, Homo sapiens; identical to SEQ ID NO: 90303
  chr3:138066780-138067014
  Hyper

SEQ ID NO: 122430 - DNA, 636 bp, Homo sapiens
  chr3:138153816-138154452
  Hyper
aacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctgggtgagccaagccgggtgggagtgggaggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaagggcgtctgggacttcgcagacttactcgggttggaatcagaaggcatttcttccacccgcctgttgattcagagaacgaacgccggacgcaaaacgtagatgggcaaataccgcagtgacagaaacggcgggcccagttgctttcggccgaggcctggactgcggtagggggagggc

SEQ ID NO: 122431 - DNA, 182 bp, Homo sapiens; identical to SEQ ID NO: 90305
  chr3:138157733-138157915
  Hypo

SEQ ID NO: 122432 - DNA, 342 bp, Homo sapiens; identical to SEQ ID NO: 90307
  chr3:138655796-138656138
  Hyper

SEQ ID NO: 122433 - DNA, 278 bp, Homo sapiens; identical to SEQ ID NO: 90308
  chr3:138656668-138656946
  Hyper

SEQ ID NO: 122434 - DNA, 30 bp, Homo sapiens; identical to SEQ ID NO: 90309
  chr3:138657192-138657222
  Hyper

SEQ ID NO: 122435 - DNA, 1688 bp, Homo sapiens
  chr3:138657432-138659120
  Hyper
cggctgacaggagagcgttgcgcagaaaattcgaggccgggcgctggaggagtctccgcggcccggagaaggcacagaggcgcccctgagaggcgcagctggaacaggcgatgcacgggttcggatctggccggccaaccgagcccagcggtcgcgaaaaccagagtcgccacagaggttgagcacgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggggtggggacagcccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggagccccgggcggggtctcagcgcccaccagctgtgccttcagggcttgggtgttcgctgcaacggcaaccgcgtgagcctcactcccacggccaaggggctagggcagggtggatgcaatcgcgtgcgcctggccccggaaggtgctcgcagggggtgcctg

SEQ ID NO: 122436 - DNA, 361 bp, Homo sapiens
  chr3:138662087-138662448
  Hyper
ccctgaggttcctaccgcctgaccactggagggctgaagtgagaggcctgcaggctcattcccgtggcgcaaaaccgctcctggcccaccagccggcctggacctgccgccacattgctggccaggccccgagatagacggggggggggcagtgagggctgggtgcggggtctagtctcagctgagcagcagcccgcaagaaccggcggatctatcctatcagaagtcggaagtcatctatcccatcagaagagtgaaagccgaccaccccctaatccgcctgggagaaccagactgcaaccaggtcaaacgcctgtgtgcctgcgcggaagcatggatcttaattcgttatttggggatc

SEQ ID NO: 122437 - DNA, 50 bp, Homo sapiens; identical to SEQ ID NO: 90316
  chr3:138662799-138662849
  Hyper

SEQ ID NO: 122438 - DNA, 37 bp, Homo sapiens; identical to SEQ ID NO: 90317
  chr3:138663076-138663113
  Hyper

SEQ ID NO: 122439 - DNA, 2814 bp, Homo sapiens
  chr3:138663703-138666517
  Hyper
aaaacattagccagccgccggggcccggaggtgcccgaagcgacgggactgatagcggaggaaacgcagcctccctccgcgcccgcccgcggtgtaaaccgagtacaggccgtggagccaggctgccccggctcccgctgggtcccaacccccgccccgcctagtgggccccgcggcaagcggcttctgaacagcttcaagagggttcgcggagcaaacacacgtattggtccgtccctttctcgggcagcgcggtcccgccatcagtcctgtccggcgcgtctagccatggactgcacggcagtcgggcggggaacgcggagagcgagcgcaccgacctgtgagagaaggccaagaggtctgcgctgccgacgcccggtcgcacctccgccccgggccctttccgcggtgaatttgggcaggagacgctggggctccggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgtcgcgcgtccctgcatcctcgcatccgtctgcaccggcatgcggtgggctctcagagatcgaggcgcgaatgcagcgcgccggtcttgctgtcgtggtcccagtaagagcaatgcatcatggcgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttcactacgccggggggcagcgccatgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggctccttgactgtgcgaccggtctctggggccagcagggcccccgccgcgtcctcgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccgtcttgaggctgaacttctagctcggggctggggaggggcgagacggcgagggggctggacggggtagggtggggagagctgctctgaggctttgggaaagtcagcccagaaacgggtgtgactgtacgaagaagcctcggcctggcctgtccctcgcgctctcagagtgac

SEQ ID NO: 122440 - DNA, 947 bp, Homo sapiens
  chr3:138668596-138669543
  Hyper
gaatcctctccttgccggcccagccagaggtgggtgaaccgggcgctccaggaaacggtgcggggcgccctgatttacttctcaaccttcggaggtaggctggttgctggcgaggtcgggatcctctctgaacagggcatactgtgcctaggttttgtggacgccagggccggttccttttctccccgcggcattggggcgacgcagggcccccggcttagtgaccttggggcggcgctcacctccaaaggccagggtggtgggctgggcagaactcactgcctctttgccccagttttccagggtcccgcagctgcaattcagcagccaccggcgcctcctgaccgtggtcccaccgtagcgccgcctgcggatacggttccagtgaaccgccgattgagcgcagtctcagctcccgcgcctcctcgcagcctggccccgcgcctcggaggtcccgacagccggcgcgagcaatctacacggctctgatacagacgcttttctccccagggccgggaatcctgcaacagcggcagaagccgcccgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccac

SEQ ID NO: 122441 - DNA, 417 bp, Homo sapiens
  chr3:138679148-138679565
  Hyper
aatgttaggggtcctcgtatgtgttcatggatagtgaggcagtagcatgaagaggcgggaaattcaggatgggagagggctgcaggacaaagactgcgggcagtccggccgggttcctgggtggaggaaggaaggcacgtttcccggtgttgttccaggcctgacgggtgttcagggtgtaggactcagggtgtaggacgagcgtggcgcgtccctccggaccggaagcggggctcaccccagcgacggggggcttcctcactttcgtaccgcgctccttccccgcagaggcccgccggaagcggcagccggcgatggggaccagggcccgggacaggcgggtgatgtctttcctggaggcagcgatgcaggaagcccgcggggagccccggcttcgccgctcggggttcaggtgca

SEQ ID NO: 122442 - DNA, 222 bp, Homo sapiens; identical to SEQ ID NO: 90328
  chr3:139059248-139059470
  Hypo

SEQ ID NO: 122443 - DNA, 492 bp, Homo sapiens; identical to SEQ ID NO: 90331
  chr3:139258180-139258672
  Hyper

SEQ ID NO: 122444 - DNA, 448 bp, Homo sapiens; identical to SEQ ID NO: 90333
  chr3:139396418-139396866
  Hyper

SEQ ID NO: 122445 - DNA, 1656 bp, Homo sapiens
  chr3:139653445-139655101
  Hyper
ttctcggagatgacgcggagccctgccattgccatccaggtccaaggctatctactctgcccgacaacccctagcaccactaggcgctgctctagtgtgcgcctggcgccctccccagaccagtcgacgcagaacgcccagagacccagccaagggcaagacccttagcgacgcccgtcagtcctctccgcccagatatcagttcaaagggcatggcaggtcagggtccctcgcgccaccccagatgaccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagacggctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggatcagcggcggtgctttcaaggagggagccgagctgtgacttgtctcccagctcggggatggagtggaaacttgtaggctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtcaggcgagcctggaagccggcgaaccccggactttgacagct

SEQ ID NO: 122446 - DNA, 30 bp, Homo sapiens; identical to SEQ ID NO: 90338
  chr3:139884168-139884198
  Hypo

SEQ ID NO: 122447 - DNA, 120 bp, Homo sapiens; identical to SEQ ID NO: 90339
  chr3:140434129-140434249
  Hypo

SEQ ID NO: 122448 - DNA, 22 bp, Homo sapiens
  chr3:140732060-140732082
  Hypo
aaagcccttagtggccgggcgc

SEQ ID NO: 122449 - DNA, 2540 bp, Homo sapiens
  chr3:140769436-140771976
  Hyper
gttagcaaatgactgcgtaatggacctaaagtcaattctgggagcacagacgagggccaccaaaccaagaactttcaatttccccaaggaagcgcagataccagaagcaccctcgaggcttctgttttggccacgccctttaccccatcgctcagttcaggctcccaatgaggcggcccaccatcagcgctggtagagcaaagagaccgacttcctgcgcctcgggtgggcggggaacgctccttgagcaggtgcggtatgaaattggactttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatgaatccgggaggacccgcgcgcaggaatgaatgcgagagctagggagtgagcgggcgagtgggcgggtgagtgaatggcgaccgcgccgccgccttggcacaggggcgcgggcgcgggctccacttccctctcccgccagctggtggcctcgagaaggtggcggcgccggcagcggcccgagctgggacggccggggcgcgggatggtgggggaaggggcgttcccggcgaccgcgccttccgcggctattggattagtggccttcagggatgagctcagccagatcggctttcagctgcagcctccgggccggccgggaaggcggggagcgggcggcggcggcggaggagggggaggcggcggcggctgcagcatccagagctggccgtggcggccggcgcgccccgcgcacaaaagcacccagccccaggggagggcgatgaacacaccacatcccgggcccgggccccagctgctgctaccgctgcgtgcgctcagggcgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccggcgcctgagcgccaacttcgccaagaacgctcctaactccaggccatcctgcagcgcagagggggcgctgctgccgggcatcagccgtgaggacgcgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagtattattattagctttgcgagcccaagcttgttatccaactttccgaagctgcagcagttccgtcgtccgtgtaatggggacaataattcctgggggtctgttcgtccggggtattcggagaggtggaagtaaagcacgggtcacgcaataggcaccggtggctgttgttaccgtttattcctgactctggggcagtgaggctggtcgcctggcccgagagcgactcagggaccagtcctggccttgcttgaatacaaacttgtctatgctcgggaagggagggggttgggagctcaggaaaccctaggcgcagggctctgggaaggagggagggggtcagagacttgagcgcggcaaatgtgtccgccctggtcgctctgtacgcgccaggggctccaagccagaaggggacgccgagcccccgacctctgactggcgggagaaccgggggagtggctgctcccgccggcccatggccaagcgcagacggctgccggcaggaaggagaggagggcacttttctgtaccgctgtcgcgagaaggtggagagttctcagttctggagtcaggcttgggttcgaatctgtctccaccaccagctcgcggtgtgaccttgggcaagttctctaacctccccccgcttggtttcctcttctgcgccccactctcctc

SEQ ID NO: 122450 - DNA, 43 bp, Homo sapiens; identical to SEQ ID NO: 90345
  chr3:140785562-140785605
  Hypo

SEQ ID NO: 122451 - DNA, 375 bp, Homo sapiens; identical to SEQ ID NO: 90346
  chr3:141174296-141174671
  Hypo

SEQ ID NO: 122452 - DNA, 482 bp, Homo sapiens; identical to SEQ ID NO: 90347
  chr3:141378730-141379212
  Hyper

SEQ ID NO: 122453 - DNA, 138 bp, Homo sapiens; identical to SEQ ID NO: 40015
  chr3:141481968-141482106
  Hypo

SEQ ID NO: 122454 - DNA, 30 bp, Homo sapiens; identical to SEQ ID NO: 90349
  chr3:141508206-141508236
  Hypo

SEQ ID NO: 122455 - DNA, 665 bp, Homo sapiens; identical to SEQ ID NO: 28443
  chr3:141516079-141516744
  Hyper

SEQ ID NO: 122456 - DNA, 86 bp, Homo sapiens; identical to SEQ ID NO: 90351
  chr3:141549437-141549523
  Hypo

SEQ ID NO: 122457 - DNA, 77 bp, Homo sapiens; identical to SEQ ID NO: 90352
  chr3:141637559-141637636
  Hypo

SEQ ID NO: 122458 - DNA, 30 bp, Homo sapiens; identical to SEQ ID NO: 40016
  chr3:142337360-142337390
  Hypo

SEQ ID NO: 122459 - DNA, 305 bp, Homo sapiens; identical to SEQ ID NO: 90355
  chr3:142443546-142443851
  Hyper

SEQ ID NO: 122460 - DNA, 30 bp, Homo sapiens; identical to SEQ ID NO: 90356
  chr3:142499588-142499618
  Hypo

SEQ ID NO: 122461 - DNA, 30 bp, Homo sapiens; identical to SEQ ID NO: 90357
  chr3:142499820-142499850
  Hypo

SEQ ID NO: 122462 - DNA, 466 bp, Homo sapiens; identical to SEQ ID NO: 90358
  chr3:142607418-142607884
  Hyper

SEQ ID NO: 122463 - DNA, 1409 bp, Homo sapiens
  chr3:142681832-142683241
  Hyper
ggtggaagggcacgtcgccgccgctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcccgacaggatgaagcactccacgaagtcgtcgggcacctcgtcccagcgcagcagcggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgccctgt

SEQ ID NO: 122464 - DNA, 22 bp, Homo sapiens
  chr3:142718194-142718216
  Hypo
gggcgcggtggctcacgcctgt

SEQ ID NO: 122465 - DNA, 21 bp, Homo sapiens
  chr3:142718456-142718477
  Hypo
gcgagacgtctcaaaacaaac

SEQ ID NO: 122466 - DNA, 44 bp, Homo sapiens; identical to SEQ ID NO: 90363
  chr3:142791151-142791195
  Hypo

SEQ ID NO: 122467 - DNA, 17 bp, Homo sapiens
  chr3:142802592-142802609
  Hypo
agcgtgagccaccgtgc

SEQ ID NO: 122468 - DNA, 2458 bp, Homo sapiens
  chr3:142837831-142840289
  Hyper
ttctgcaaattagaacggggcgttcccctcccccatcaccccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgttt

SEQ ID NO: 122469 - DNA, 24 bp, Homo sapiens
  chr3:142853160-142853184
  Hypo
gggctcaagcgatcctcccatcta

SEQ ID NO: 122470 - DNA, 30 bp, Homo sapiens; identical to SEQ ID NO: 90376
  chr3:142859875-142859905
  Hypo

SEQ ID NO: 122471 - DNA, 451 bp, Homo sapiens; identical to SEQ ID NO: 90377
  chr3:142895864-142896315
  Hypo

SEQ ID NO: 122472 - DNA, 22 bp, Homo sapiens
  chr3:142913215-142913237
  Hypo
aaagtctcactttgtcgagcag

SEQ ID NO: 122473 - DNA, 22 bp, Homo sapiens
  chr3:142913477-142913499
  Hypo
caaagtacggggattgcaggcg

SEQ ID NO: 122474 - DNA, 30 bp, Homo sapiens; identical to SEQ ID NO: 90380
  chr3:142957298-142957328
  Hypo

SEQ ID NO: 122475 - DNA, 21 bp, Homo sapiens
  chr3:142957630-142957651
  Hypo
ccaccgcgcctggcctgtaat

SEQ ID NO: 122476 - DNA, 260 bp, Homo sapiens; identical to SEQ ID NO: 90382
  chr3:142973621-142973881
  Hypo

SEQ ID NO: 122477 - DNA, 200 bp, Homo sapiens; identical to SEQ ID NO: 90383
  chr3:143024050-143024250
  Hypo

SEQ ID NO: 122478 - DNA, 37 bp, Homo sapiens; identical to SEQ ID NO: 90384
  chr3:143036841-143036878
  Hypo

SEQ ID NO: 122479 - DNA, 45 bp, Homo sapiens; identical to SEQ ID NO: 14579
  chr3:143092973-143093018
  Hypo

SEQ ID NO: 122480 - DNA, 34 bp, Homo sapiens; identical to SEQ ID NO: 40026
  chr3:143151477-143151511
  Hypo

SEQ ID NO: 122481 - DNA, 101 bp, Homo sapiens; identical to SEQ ID NO: 90387
  chr3:143166561-143166662
  Hypo

SEQ ID NO: 122482 - DNA, 30 bp, Homo sapiens; identical to SEQ ID NO: 90388
  chr3:143189998-143190028
  Hypo

SEQ ID NO: 122483 - DNA, 38 bp, Homo sapiens; identical to SEQ ID NO: 40027
  chr3:143210840-143210878
  Hypo

SEQ ID NO: 122484 - DNA, 30 bp, Homo sapiens; identical to SEQ ID NO: 90390
  chr3:143346055-143346085
  Hypo

SEQ ID NO: 122485 - DNA, 29 bp, Homo sapiens
  chr3:143367116-143367145
  Hypo
accagggaactgtttcgtggaaggcgatt

SEQ ID NO: 122486 - DNA, 231 bp, Homo sapiens
  chr3:143566691-143566922
  Hyper
caaaaacaaacagctcgccctcgactccccacatgacaatggacccgcatctgtcaacagacttgcattatgtgccgtgtgagaacatgactgtgacatttgctctcgtgacatggcaaatttcggcggcttgtctgtaaagagattagcattcgttacgctgcagcacctttcatcaaactaatgacatttcaatcagcacattttctccagtttcggtactttgctatc

SEQ ID NO: 122487 - DNA, 30 bp, Homo sapiens; identical to SEQ ID NO: 90394
  chr3:144206683-144206713
  Hypo

SEQ ID NO: 122488 - DNA, 184 bp, Homo sapiens; identical to SEQ ID NO: 90395
  chr3:144314841-144315025
  Hypo

SEQ ID NO: 122489 - DNA, 167 bp, Homo sapiens; identical to SEQ ID NO: 90398
  chr3:145878028-145878195
  Hyper

SEQ ID NO: 122490 - DNA, 64 bp, Homo sapiens; identical to SEQ ID NO: 90399
  chr3:145878489-145878553
  Hyper

SEQ ID NO: 122491 - DNA, 69 bp, Homo sapiens; identical to SEQ ID NO: 90400
  chr3:145878868-145878937
  Hyper

SEQ ID NO: 122492 - DNA, 28 bp, Homo sapiens
  chr3:145908278-145908306
  Hypo
aagtctatcctggcccggtgcggtggct

SEQ ID NO: 122493 - DNA, 84 bp, Homo sapiens; identical to SEQ ID NO: 90402
  chr3:145968319-145968403
  Hyper

SEQ ID NO: 122494 - DNA, 19 bp, Homo sapiens
  chr3:145970676-145970695
  Hypo
tccccgactgagctggtct

SEQ ID NO: 122495 - DNA, 58 bp, Homo sapiens; identical to SEQ ID NO: 40028
  chr3:146187920-146187978
  Hypo

SEQ ID NO: 122496 - DNA, 37 bp, Homo sapiens; identical to SEQ ID NO: 40029
  chr3:146188305-146188342
  Hypo

SEQ ID NO: 122497 - DNA, 116 bp, Homo sapiens; identical to SEQ ID NO: 90409
  chr3:147072554-147072670
  Hyper

SEQ ID NO: 122498 - DNA, 30 bp, Homo sapiens; identical to SEQ ID NO: 28462
  chr3:147073006-147073036
  Hyper

SEQ ID NO: 122499 - DNA, 30 bp, Homo sapiens; identical to SEQ ID NO: 90411
  chr3:147073354-147073384
  Hyper

SEQ ID NO: 122500 - DNA, 144 bp, Homo sapiens; identical to SEQ ID NO: 90412
  chr3:147073957-147074101
  Hyper

SEQ ID NO: 122501 - DNA, 176 bp, Homo sapiens; identical to SEQ ID NO: 90413
  chr3:147074915-147075091
  Hyper

SEQ ID NO: 122502 - DNA, 563 bp, Homo sapiens
  chr3:147076998-147077561
  Hyper
cctttctcctcctcccgccaggtgctggagtttttacaccggtgctttgttacttaaggagaaaaactgcctgcatggtgcaggatgctgaaggggagacagaaagagaaggtctggcggcctgggggcggccatgcgtgtagccctccccggtatgtttttgtgcacagagttggcgccagggcagcgccccagaccccagtcctggctggacaataaatgaccggacagctgcggccgctacaaaggagcccctcgaccgcgtcgctgtttacttagtgtcgggtctgaccccagggctgcttgcggccagtacagatgctgattccaccctgggaacaggctttctgtcctccgttcgccgcgctagccagcacgtgtttgcaaacaacttaactgacttctcgaatattcatctgctgacgctggctttagggaaatttgaggggagactcgctgggcaaagacccgaggcctctggaggtttggctccccacacgcaggtcccgtccgcctcgctgattatcttttcttctttccagaggaagcggataggcttcagc

SEQ ID NO: 122503 - DNA, 287 bp, Homo sapiens; identical to SEQ ID NO: 28466
  chr3:147078959-147079246
  Hyper

SEQ ID NO: 122504 - DNA, 793 bp, Homo sapiens; identical to SEQ ID NO: 90416
  chr3:147087044-147087837
  Hyper

SEQ ID NO: 122505 - DNA, 326 bp, Homo sapiens; identical to SEQ ID NO: 90417
  chr3:147088241-147088567
  Hyper

SEQ ID NO: 122506 - DNA, 26 bp, Homo sapiens
  chr3:147088627-147088653
  Hyper
caaagctgcaacggaagagattttca

SEQ ID NO: 122507 - DNA, 94 bp, Homo sapiens; identical to SEQ ID NO: 28470
  chr3:147088939-147089033
  Hyper

SEQ ID NO: 122508 - DNA, 407 bp, Homo sapiens; identical to SEQ ID NO: 90420
  chr3:147090416-147090823
  Hyper

SEQ ID NO: 122509 - DNA, 114 bp, Homo sapiens; identical to SEQ ID NO: 90421
  chr3:147096028-147096142
  Hyper

SEQ ID NO: 122510 - DNA, 30 bp, Homo sapiens; identical to SEQ ID NO: 90422
  chr3:147096695-147096725
  Hyper

SEQ ID NO: 122511 - DNA, 30 bp, Homo sapiens; identical to SEQ ID NO: 90423
  chr3:147098132-147098162
  Hyper

SEQ ID NO: 122512 - DNA, 308 bp, Homo sapiens; identical to SEQ ID NO: 28473
  chr3:147098379-147098687
  Hyper

SEQ ID NO: 122513 - DNA, 35 bp, Homo sapiens; identical to SEQ ID NO: 28474
  chr3:147102662-147102697
  Hyper

SEQ ID NO: 122514 - DNA, 284 bp, Homo sapiens; identical to SEQ ID NO: 90426
  chr3:147102945-147103229
  Hyper

SEQ ID NO: 122515 - DNA, 396 bp, Homo sapiens
  chr3:147105872-147106268
  Hyper
gagtgaacccctaaacgtgggcaagtcgggttctagaaaggaagtatatactggagagcgcagtgacagtattaaatggcgtgaaagcaaaggtcagcgcaaatgtatcttaatagagtgtctgtagtgaagtgtgccgcctttgaagcggccgctccccgcgcgtatttccatggcgagcctaacgcggcatgctgatgcaccgtcaaactcacactttcaaccccaaaacccgactctttgaacaacccgagcttgattagacctttctccttttctttcccctcttacaaaccatttcctcgcctttagaaactcgccatcaaacccaaacgcgccctctgatcaccgcagaaagcagaaacaaagggggctgagcggcgattcaagcggctc

SEQ ID NO: 122516 - DNA, 169 bp, Homo sapiens
  chr3:147106520-147106689
  Hyper
accatgaagatgcaccgtggcgaagaaacactgctttgtgcgcgggccctttgatgtagcaggcgcgagatgcggggcgctcagctgcgcggagcgagattaccttgcgagcaacgcggtggacatctgtaacaagcaaatgaaaaattaaaggcgattagtggccgac

SEQ ID NO: 122517 - DNA, 1959 bp, Homo sapiens
  chr3:147108766-147110725
  Hyper
cctgggacttgtggccgcagtccgacgagggcgacacgagggcagacggtgtagccgaatcgtagccagagctgggcggcggcgagcgcccgtgcaccttcatgtgcttacgcagcgagctggggtgcgtgtagcacttgtcgcagccccgcaccttgcacgtgtatggcttgtcgctagtgtgcacgtgcgaatgcttcttacggtcgctgctgttggcgaagcgccgctcgcagccctcgaactcgcatctgaagggcttctcgcctggcggaggcaacgcagagacattagtgcttgtgggtcgtgttcccgtcaggtgcttgccaccctcccccattcgtctctcattttctggaaaagaactacaaaatattttcagaaatccctttccacggcgcctcaggtcgagcacccctttccctcgtgcagagagcgcccccggtgccctctcttgaacgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgtgtgcataaagtggattcgtgctgcagggagaggtattctgagcaatgattcacttcagaagagatttttacaggaatggagccccctccctctttccttctaccccctgagggcaaacatttagcagcattcttcaaatcttgcctaaaccttccgggatccctccagatacgctcgccagtaataatatttcattacgctgctccagaggcttcctggagaccgtgctgtgggcagctggccctcccagtccgcactgacttgcgatgtcgaccggtctgcccagaccacccccacctggctgtcgggcctctcggtcctaagacgaggggttggcgcggtagggtccgcacaggccaaatgggatccgaggtgtctaccgcaaccacgcccttgagcgctgcggcttcgggaagaaaacagctgctgctgtcaggccaggcctggctccgcagcccggagggccaccaggcggctggcataggccggggaggggctgggatcggtggctgcgatgccctgtagagccgagggaaggcgcgagtgcacgttagagtgacaatattggccggaccgagccccaatcggggagctcacggccagctgaattcgctgacgtgtaggagaggaaaggaccccgagaacccggaagcctagattcctgccggagctgcaagtgctgcggaaatgggggaagaaggtttctgggcgctttaaacaaatggctgcctcccagcgctctgagttaagggaccggctacctagcgtctagctgaggaggaagacgcgcagctggagaactgttgcctttgtagttgcttctcccgccgcatccaggaaaaacaggcgctttggggctggttagaacaaacaaagccccaattcccgagccctgttgaggctcggacagagaggtttgcgcacaacctgcgcttctgcgcaatcagcggctcctgagcccgggtctccggcaccacctggtcgctggattcccaccctacaggagcacagctagtacactgaacagtctggaaggtgttggcacctgccatttcgcgggacactggcaccattttataaaacagtgatagaaagatgcggaataaatcagtg

SEQ ID NO: 122518 - DNA, 713 bp, Homo sapiens
  chr3:147110927-147111640
  Hyper
ccccaacaaaaatcccgccaaacgcttatccgatctcgtgagcgcctcactggacattcacgtaaaacaaaaacaattatttcgctccagacgaggagcagaggagaaaacagcagtgcactgagtgataccggcagccgggaagttcgcaggcccctaggaggccaggtgaggccgcgccccagcttgctccggagctgcaggaggcgccctggtctctgcgcttgacatcacccccgccccccgccaacacccggcctccagtccttccccctccctccagctccctgcactgcgccctgggtgggtgggtgaatgtgaagaggcggcgttgggctaggcccctgcagcccgctcggagcgtcctaggcccggggctgcgctgtgaaagacccagattctcatcccagaggcccagcagtcctgaaaggcctcctctccgaccctgagccgggtccgccgaacaaagttcggaagctcgggctagctgggccagcgccattttctcgcacttgtggctggatctggttgtcccggcgactgcgccccggcgcggtctcttttcctctacctcggatccccagcactgactcgccctcagacgccggggaaggtgtggtgagctcccggccccggccgaggggtccctggagaggagctgggtggcggtggccaggccgagcgcggttgctggcccgcgcctccctccccga

SEQ ID NO: 122519 - DNA, 378 bp, Homo sapiens; identical to SEQ ID NO: 90433
  chr3:147111965-147112343
  Hyper

SEQ ID NO: 122520 - DNA, 30 bp, Homo sapiens; identical to SEQ ID NO: 90434
  chr3:147112635-147112665
  Hyper

SEQ ID NO: 122521 - DNA, 49 bp, Homo sapiens; identical to SEQ ID NO: 90435
  chr3:147114169-147114218
  Hyper

SEQ ID NO: 122522 - DNA, 269 bp, Homo sapiens; identical to SEQ ID NO: 90436
  chr3:147126945-147127214
  Hyper

SEQ ID NO: 122523 - DNA, 713 bp, Homo sapiens
  chr3:147127613-147128326
  Hyper
aagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctct

SEQ ID NO: 122524 - DNA, 30 bp, Homo sapiens
  chr3:147128605-147128635
  Hyper
ccaaccccaaaaagtcgtgcaacaaaactt

SEQ ID NO: 122525 - DNA, 661 bp, Homo sapiens
  chr3:147136863-147137524
  Hyper
tagggggtgcaacagcgagacttccccacaacacctccaccgaaggctgggtcgtcagcgtttgagggaccctcccgccaccccgcagcctggcggggcgctttccaaatcgtcgcggcaggctctggccgggcagggcgagatgtgcgcatgcgcggcctgtggcccgaggttccacgtgctgatgaatatgcatgagactcccccgccctcgcgggctagagagagaaccaagcagaggctccggcctgtgaaagtcgctggctaggctcccaaaatagtgcggcggggtagctgcacgtgtttgttttcaaaccgcgctggtttaagtgagttcacactgcggagccgacagcagagggtagagcaacctggggctgctgccattggaacggcgagttgagcgggcctgtcagggcctctccgccgagggccgggggctgcatggtgctcgagccccagccggccacaccccagtgcatcgggtggctgggcttccagtttacaccgggcctaccagggaggccttcttctcttatcctttcccaagcccgagctgccgccccggctgttctcatatccctagcccctcggagaagacttagcctacccctagtcagagctcaggccccaggtgaccgggcagcggcttgggggaggt

SEQ ID NO: 122526 - DNA, 809 bp, Homo sapiens
  chr3:147138768-147139577
  Hyper
aggactccaagctaacgatgacctgtgtgggccttgctctgaacagaaaactcaaactcagcgtgggttcccgcgtcttccccaaaaggccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgccggcaacgctgttaccctctcctgggctggagagtggggacatcccttccccgcccctaggcgtccctggggtcggcgccagagcccgggagcgccggaggctctggctggatggcggcgaggagggctctgagtcctctcccggccaggccgagcttagtatgtggaggcggcggcgggagtgcgggcatggaccaagggaagggggacacccaaaccgcattggtgccttcctttccctccactcgcgccgtagacctccccaaattgcccgtctccggtatgactgaatctgtctgctggcctctcagctaccaactctgcccgaaatctagatcccagacctggtaagtcgcgttcctcccctaccccgccccgccaccttactagcggactctgcccgcgacagcgtgcgcgcgcgtggcctgaggcgcgcgctgagaagttgggctgatttggaactgctgcgctagttcggcctctgccgctggggtgtatacgtttatacgccgtacgctccagggtagtcaggaatgtcgcggggctccccagtgaggcgggagcgaaaagagtgcagg

SEQ ID NO: 122527 - DNA, 454 bp, Homo sapiens
  chr3:147140804-147141258
  Hyper
aagtccctggtctggcgctcagcggctgaaactgcagcgtttcggcctcacagatggggctggagttggagacgtcgctgcggccaggactgggaggccacttgcttggcgggtgaggcggctcacgcggtatttattgactggctcgggaaacgtgttcttttacttacttgtcattaaagttctaagttttaaaagcgcattcccagaaaatgcttttattctctttcccccagtaacagagcccgctaactgctttcaactggagaaggggagaaattcactcctgcacgagttcccagctactctctggtgaaagcgggagggcgaagcgaaattgtgttctagctctgagctccgcagccctccaatggctgacttccttcagctgctgtcctggggtgccgatcgctgcggcagacgcaattttccgcacctgcgtgttgttttttgc

SEQ ID NO: 122528 - DNA, 145 bp, Homo sapiens
  chr3:147142166-147142311
  Hyper
ctggcattctaactgcgacaggactttcgagcgagtgcgaggaaagcccctttcgacagttctgaggttttatccgaccctgcccgggactccctccctgcatgcccccggagctccagtccgggccacccgggggctgctgggg

SEQ ID NO: 122529 - DNA, 30 bp, Homo sapiens; identical to SEQ ID NO: 90444
  chr3:147636685-147636715
  Hypo

SEQ ID NO: 122530 - DNA, 42 bp, Homo sapiens; identical to SEQ ID NO: 90445
  chr3:148337549-148337591
  Hypo

SEQ ID NO: 122531 - DNA, 768 bp, Homo sapiens
  chr3:148415302-148416070
  Hyper
tgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggag

SEQ ID NO: 122532 - DNA, 47 bp, Homo sapiens; identical to SEQ ID NO: 90448
  chr3:148459165-148459212
  Hypo

SEQ ID NO: 122533 - DNA, 24 bp, Homo sapiens
  chr3:148463858-148463882
  Hypo
cgcgcccagcgtgaaggcttctat

SEQ ID NO: 122534 - DNA, 151 bp, Homo sapiens; identical to SEQ ID NO: 90450
  chr3:148472011-148472162
  Hypo

SEQ ID NO: 122535 - DNA, 27 bp, Homo sapiens
  chr3:148556008-148556035
  Hypo
tgggcgacagagcgagactctgtctca

SEQ ID NO: 122536 - DNA, 51 bp, Homo sapiens; identical to SEQ ID NO: 90455
  chr3:148705411-148705462
  Hypo

SEQ ID NO: 122537 - DNA, 27 bp, Homo sapiens
  chr3:148802983-148803010
  Hypo
actacaattatgggccggatgcggtgg

SEQ ID NO: 122538 - DNA, 26 bp, Homo sapiens
  chr3:148803250-148803276
  Hypo
ggacgacagagcgagactccatgtca

SEQ ID NO: 122539 - DNA, 35 bp, Homo sapiens; identical to SEQ ID NO: 90458
  chr3:148804164-148804199
  Hyper

SEQ ID NO: 122540 - DNA, 30 bp, Homo sapiens; identical to SEQ ID NO: 28493
  chr3:148943086-148943116
  Hyper

SEQ ID NO: 122541 - DNA, 33 bp, Homo sapiens; identical to SEQ ID NO: 90460
  chr3:149286506-149286539
  Hypo

SEQ ID NO: 122542 - DNA, 459 bp, Homo sapiens; identical to SEQ ID NO: 90461
  chr3:149374947-149375406
  Hyper

SEQ ID NO: 122543 - DNA, 415 bp, Homo sapiens; identical to SEQ ID NO: 90462
  chr3:149375996-149376411
  Hyper

SEQ ID NO: 122544 - DNA, 165 bp, Homo sapiens; identical to SEQ ID NO: 90464
  chr3:149687803-149687968
  Hyper

SEQ ID NO: 122545 - DNA, 217 bp, Homo sapiens; identical to SEQ ID NO: 90465
  chr3:149956581-149956798
  Hypo

SEQ ID NO: 122546 - DNA, 35 bp, Homo sapiens; identical to SEQ ID NO: 90466
  chr3:150062858-150062893
  Hypo

SEQ ID NO: 122547 - DNA, 161 bp, Homo sapiens; identical to SEQ ID NO: 14584
  chr3:150135175-150135336
  Hypo

SEQ ID NO: 122548 - DNA, 88 bp, Homo sapiens; identical to SEQ ID NO: 40037
  chr3:150237908-150237996
  Hypo

SEQ ID NO: 122549 - DNA, 258 bp, Homo sapiens; identical to SEQ ID NO: 90469
  chr3:150443222-150443480
  Hypo

SEQ ID NO: 122550 - DNA, 56 bp, Homo sapiens; identical to SEQ ID NO: 90470
  chr3:150505714-150505770
  Hyper

SEQ ID NO: 122551 - DNA, 88 bp, Homo sapiens; identical to SEQ ID NO: 90471
  chr3:150583707-150583795
  Hypo

SEQ ID NO: 122552 - DNA, 2210 bp, Homo sapiens
  chr3:150802887-150805097
  Hyper
agggtacagtaagaccgtggaaggttgtaaggaccagagattctgactatcaagatcctggcacgtagcgaaggctccataaatggcagccatcattcttggccaagtgcgggcgcattctcccgggcacgcctcccgcggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggctgcggcggccggagtgaccccgccgccgccagccccagcccgctagccgcggaccaacaggtaaagtgttgggggttgggggcggaagggaagaggagctggggccgtggggaggcggcgggctggaggagcccgagacgcctgcgggctggctgcccccgtcggcgctcacagccatcgctcctcacccccttccccagcccctggagggactgtaaagggttaagtcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccaccggccgcatccctgcgtctcgcgccccctccagacctgcctctgcctgcactggcccggtccgtgtccaggtggcggggtctgcggggcgcgtggcggcgggggaagggtccctgccggggaagagaggcgggggcggtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgccggcgctgcggtggaagaggtcggggagggggattagaggcgggggccaggctgggggtgctgggcgaccccccggcggcggagaccgagcggctgtcagtccccgcgctccactggggcgctcgctttccatgtgccggtcgctttcccgttgccgggccttgcacggcgccgccgggcgcttctcgggcttcttccctg

SEQ ID NO: 122553 - DNA, 30 bp, Homo sapiens; identical to SEQ ID NO: 90475
  chr3:150848389-150848419
  Hypo

SEQ ID NO: 122554 - DNA, 96 bp, Homo sapiens; identical to SEQ ID NO: 90477
  chr3:152107121-152107217
  Hypo

SEQ ID NO: 122555 - DNA, 240 bp, Homo sapiens; identical to SEQ ID NO: 90478
  chr3:152320903-152321143
  Hypo

SEQ ID NO: 122556 - DNA, 41 bp, Homo sapiens; identical to SEQ ID NO: 90479
  chr3:152321383-152321424
  Hypo

SEQ ID NO: 122557 - DNA, 30 bp, Homo sapiens; identical to SEQ ID NO: 40039
  chr3:152332728-152332758
  Hypo

SEQ ID NO: 122558 - DNA, 27 bp, Homo sapiens
  chr3:152540434-152540461
  Hypo
ttttttcttttttttcgagacggagtc

SEQ ID NO: 122559 - DNA, 1337 bp, Homo sapiens; identical to SEQ ID NO: 90482
  chr3:152552388-152553725
  Hyper

SEQ ID NO: 122560 - DNA, 22 bp, Homo sapiens
  chr3:152671180-152671202
  Hypo
acataaatgataggccggactt

SEQ ID NO: 122561 - DNA, 82 bp, Homo sapiens; identical to SEQ ID NO: 90484
  chr3:152707532-152707614
  Hypo

SEQ ID NO: 122562 - DNA, 26 bp, Homo sapiens
  chr3:152709701-152709727
  Hypo
aagacacccaggtgccgaggcaagag

SEQ ID NO: 122563 - DNA, 27 bp, Homo sapiens
  chr3:152829598-152829625
  Hypo
ggcgtgagcgaccgcacccagctgata

SEQ ID NO: 122564 - DNA, 45 bp, Homo sapiens; identical to SEQ ID NO: 90487
  chr3:152874399-152874444
  Hypo

SEQ ID NO: 122565 - DNA, 30 bp, Homo sapiens; identical to SEQ ID NO: 40041
  chr3:152877598-152877628
  Hypo

SEQ ID NO: 122566 - DNA, 72 bp, Homo sapiens; identical to SEQ ID NO: 90489
  chr3:152894314-152894386
  Hypo

SEQ ID NO: 122567 - DNA, 30 bp, Homo sapiens; identical to SEQ ID NO: 90490
  chr3:152894853-152894883
  Hypo

SEQ ID NO: 122568 - DNA, 34 bp, Homo sapiens; identical to SEQ ID NO: 90491
  chr3:152919057-152919091
  Hypo

SEQ ID NO: 122569 - DNA, 30 bp, Homo sapiens; identical to SEQ ID NO: 90492
  chr3:152961303-152961333
  Hypo

SEQ ID NO: 122570 - DNA, 25 bp, Homo sapiens
  chr3:152979662-152979687
  Hypo
ccaccacgtccggccaactcatatt

SEQ ID NO: 122571 - DNA, 30 bp, Homo sapiens; identical to SEQ ID NO: 40043
  chr3:152999015-152999045
  Hypo

SEQ ID NO: 122572 - DNA, 18 bp, Homo sapiens
  chr3:153018756-153018774
  Hypo
aaaaatatgattggccgg

SEQ ID NO: 122573 - DNA, 30 bp, Homo sapiens; identical to SEQ ID NO: 90496
  chr3:153102203-153102233
  Hypo

SEQ ID NO: 122574 - DNA, 19 bp, Homo sapiens
  chr3:153204811-153204830
  Hypo
ccatgtcaggttgggcgcg

SEQ ID NO: 122575 - DNA, 26 bp, Homo sapiens
  chr3:153224197-153224223
  Hypo
aggagccaagatggccgaataggaac

SEQ ID NO: 122576 - DNA, 22 bp, Homo sapiens
  chr3:153381610-153381632
  Hypo
ctattggctaggtgccgtggct

SEQ ID NO: 122577 - DNA, 642 bp, Homo sapiens; identical to SEQ ID NO: 90500
  chr3:153838818-153839460
  Hyper

SEQ ID NO: 122578 - DNA, 666 bp, Homo sapiens
  chr3:153839727-153840393
  Hyper
taggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcct

SEQ ID NO: 122579 - DNA, 1470 bp, Homo sapiens
  chr3:154145550-154147020
  Hyper
caagccttttctccacgcacgctgcctcagttccctttccagttccttctcctgatggacagcggggacctctgctacggagctggctccctgtccttggtgatgggctcctgggaacggcggggcacacccccagggttgggaggggtttcagcttttgagtgccggatctgcgcccgctgcctattcaagactccaccagaaaggcacagtctacaacgtgggggacgctagctaggaaacaggcgtccgtgaaacccgcatctgattctccgaatggcctttgtcgcctccctggaccctcacctccgcccatgcgcgctcgtcacagtggggcgccactctgccacctcttaatcggcttcctcctggaaggaggaacaaaagcctgttttgttccctgtcttctccctccacaactgatctctcctcccctctatcccgccctgctggagatgggcgtcgtcctctctaggcgggaatggaacggcgagaaagggatgacagaaggttgtggggaaaaaaccttttaattccctctttccttttctgaatactctctgattttgctgtgtgagacaatatccttggccaccaccgatatggaaaactaagtcgctcgcgacggaaagcgatccccatgcccctgacttttgaaaggagaagcatttagtagtaaaggtttcgcagccaactagccctgtcccgaactgccttcttctaagtgcatgtctaaaacccagcgagatacacttggaagcggacttcactgtgtgtctcttggtgactccccaaaccggcgacgccggtcccaacactcatttacactgtctggcacacacactcgcgctttgtgagcaactgcacttttaccatcatgggcagccaaaggacgacttttgtaagcgctaggatcaaagcgaagcgcttctgcgctacgctcacggtgaagctcctggtgccatagagagtcccccggttctcacgcctgcaggcttcagccccagcggcagcgggcgcacccggtccgaacacggtgtcggagctcggagagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccgatcttctggaggctgtctggctccccacacctctgtgcatcgtataaaagttgta

SEQ ID NO: 122580 - DNA, 18 bp, Homo sapiens
  chr3:154179223-154179241
  Hypo
tctgagatggagtttcgc

SEQ ID NO: 122581 - DNA, 30 bp, Homo sapiens; identical to SEQ ID NO: 90508
  chr3:154373134-154373164
  Hypo

SEQ ID NO: 122582 - DNA, 30 bp, Homo sapiens; identical to SEQ ID NO: 90509
  chr3:154797184-154797214
  Hyper

SEQ ID NO: 122583 - DNA, 730 bp, Homo sapiens
  chr3:154797461-154798191
  Hyper
gagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttggg

SEQ ID NO: 122584 - DNA, 30 bp, Homo sapiens; identical to SEQ ID NO: 90512
  chr3:155668471-155668501
  Hypo

SEQ ID NO: 122585 - DNA, 76 bp, Homo sapiens; identical to SEQ ID NO: 90513
  chr3:156002795-156002871
  Hypo

SEQ ID NO: 122586 - DNA, 915 bp, Homo sapiens
  chr3:156009024-156009939
  Hyper
agcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggtatgcacgtaagattccctct

SEQ ID NO: 122587 - DNA, 328 bp, Homo sapiens
  chr3:156534211-156534539
  Hyper
tcctttcagcctcagcgagcgctgcccttcattaccccccagcgcacttctggacactgcgccgggtcgccggggtcagccgcccggccacgaaagtcgcccccagcgtgccccaggcgtcagtgcacgccgggctcccggctccaggcaggcggggtgaggcagctccgcgaaggccactcgctggcgaccccttcccgggtctcctagccctggccgggctgcccccgcgcccgcccccgccctcgaaatccaggcagtgcgggaggccgccttgctgctctctccgcccgcacagggccgcccgacggagcgggcagggagcagg

SEQ ID NO: 122588 - DNA, 30 bp, Homo sapiens; identical to SEQ ID NO: 90517
  chr3:156543165-156543195
  Hypo

SEQ ID NO: 122589 - DNA, 23 bp, Homo sapiens
  chr3:156999611-156999634
  Hypo
actacgcccggccaaaattgagt

SEQ ID NO: 122590 - DNA, 182 bp, Homo sapiens; identical to SEQ ID NO: 28512
  chr3:157155252-157155434
  Hyper

SEQ ID NO: 122591 - DNA, 77 bp, Homo sapiens; identical to SEQ ID NO: 90520
  chr3:157155701-157155778
  Hyper

SEQ ID NO: 122592 - DNA, 351 bp, Homo sapiens; identical to SEQ ID NO: 90521
  chr3:157156015-157156366
  Hyper

SEQ ID NO: 122593 - DNA, 52 bp, Homo sapiens; identical to SEQ ID NO: 90522
  chr3:157217149-157217201
  Hyper

SEQ ID NO: 122594 - DNA, 121 bp, Homo sapiens; identical to SEQ ID NO: 90523
  chr3:157261112-157261233
  Hyper

SEQ ID NO: 122595 - DNA, 101 bp, Homo sapiens; identical to SEQ ID NO: 40046
  chr3:157303466-157303567
  Hypo

SEQ ID NO: 122596 - DNA, 1691 bp, Homo sapiens
  chr3:157812154-157813845
  Hyper
aagaggaggcaagggcgccgcgagctccccggatgcactggtcccacaggccgtgcccgagtggagcactgcgaatggggccaagaaattttggcctttctcgccggacctggctgcctccgcgggcctctccgcctaccgcgctcccgccgcggcccgactcccgcgggtctccgcgccgaacccacctggctcctatcgcacgggacattcccgacccacccacgccgcgtcactgagcctctgtaccgatacccggcgcctccgccagcagggcctggacgcaccgcctcctttgacctcgggcttcccccgcgctccgctgcttggggcagactggccccgagagggagccaccatctcccctgctccagggtctccagggtccgaacccgtgttgggatctgggttaggattagggtttggagcttggagcctgcctgttaggacccccggccccggcgccgactggagctcgctggaggccacaggaccacggcggatggcctggctgcttcagggcgtaccatgcccgcaggcagatgtttattattaaaaactaccgacgttcatcaaccaggagacccgcaaggcctgcgcactgaatacggcccaaatcctgttcagtggtctttgaaagttaaaagaaagaaacctatcgcccacgtctatgctgaggaacagctttgaatacgagctaagacctgggagagggccaagtgggggtggtggggaacactgctggaggatgtggggctttggcaggggttttacgcaccctccagcacgagggtggggggtcccaggggacgctcaggactctttcagtctttgcggaaggtcccgtcatcacaagagcccgcgcgggaaggaaagttcctgccttggacatggtcagggccgagtcttcaaagtctccaactatccccacacaggcagcacctttgggctttactagtgggatttcttccagaagggggccacgacatggggagagagagctcctcattattttcaaggccaggcttttcctaaacccgattctggcttccaccttctaaatttaaccaatgaagaagctgcttcagccaaccctaaacaggagtgtcagatggggaatcctccctccacagtgccctggcctgcccgcctttgcggctcttttcccgctccgaagtcagcacctgccccgctccagagagggtcaacgaactgggactgattgtcgattatgccataccaaacccaggttgatttcgctccgcaggatccctccttccttcctcccaaaagtgtccccagataaagactggaattatagcaaaacgaataacgagagtccatcttggggaaggaagttactctatcctatgttattttacttcttatctgttctttcattaatttggtataaccctgtttctatgctgggtggataaaatggagggggccggcggaaatgcgctcagcgctaacgacagccacagagccacccttcttactgccccttgactgcggcacgtaagagcagaggcaagcgcttttccaagttggtatattcgagagagtgatacgcattaatcaaaagggaaagactatcccggatattttaatagtaacaggaacaaagatgactcgaaccccatcaaatgaaacgatattttcattcaattgatcgcaaagtgtcttca

SEQ ID NO: 122597 - DNA, 34 bp, Homo sapiens; identical to SEQ ID NO: 90528
  chr3:157815889-157815923
  Hyper

SEQ ID NO: 122598 - DNA, 1253 bp, Homo sapiens
  chr3:157820458-157821711
  Hyper
ctgggtacctgcactcgggcctccgacaggcccagtcgctggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaagcgcaaaggtcaagtctgagcggccgcctggggcaaggtgggcagtcatccaccacctccttcacaaacgtacctcgactcaccgcctcactattcaccccccagtcaccggccttccccagcaaacaccaaatggtttccactcactttcgcactcacttgctccgcagcactcacagaaatcaaaggcgcagcgccaggcctctcacagagcaaagtctggacataagggcgcggcaaggccacccactggcctctcacaccggccattcccagaaggctggctcgttctcaggccagctctcaccaccgctggctctctgcctaccgcaaacttgctggtctaatttaggaacaattgggccgaaaggtatcagcgagagcaacagaccccggtgttgtgccgcacagggagccgcatccgcagacgcccctcgctgcccctgggctcgggccaaaccctgcataaggtcccctggacagccaggtaatctccgtcccgcctgcccgaccggggtcgcacgagcacaggcgcccacgccatgttggctgcccaaagggctcgccgcccaagccgggccagaaggcaggaggcggaaaaccagcctccggtggcgggcgaaagcaaccgctctttctgttctctcttcgccctccctcgtggaaacgcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcct

SEQ ID NO: 122599 - DNA, 56 bp, Homo sapiens; identical to SEQ ID NO: 90531
  chr3:157822030-157822086
  Hyper

SEQ ID NO: 122600 - DNA, 1035 bp, Homo sapiens
  chr3:157822839-157823874
  Hyper
aacacaccaagaaaccgaaacgcctcgcccgggagaagcagcgtagcctggacctcagctttcgttggcttccttctaccttgaaagagaatgggaagttttggcccctaagatccaaagattcaggggctctgcggagttcgaggggtcttggcggccccaaacacctaggcgaccggagggttaagctttccacctctgccccttctccctcccggcaaactctgcgctagaggctagctttagtcccgccgtctggttcagcaccccctcctgcagcccggccccgcgaacttccacgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttcct

SEQ ID NO: 122601 - DNA, 218 bp, Homo sapiens
  chr3:157824133-157824351
  Hyper
cttccctgccggagcgcgcttgttcaatgttaagatctttgacaattcttcctgcggagagttcagatctgatagcgacgctgcgcttgaagtcccactatttatacttcctaacggcggcctcttgttttgagtaaattacctcccctcgcaactcggagtgagcccccttcccgggtagcagtcgcgcctctaccgggggttggggaggggaaaag

SEQ ID NO: 122602 - DNA, 997 bp, Homo sapiens
  chr3:157824411-157825408
  Hyper
aggagagagagagattggagttcgggcgggctggggctggagtggtagggcagcacagggggaccggagggggcggggagagaaggccggtccccggccgctcaggttttcagatagcccctgccgcctgtgctcttggccattaatccaggattgacaagaatccctaattaatttaattaggcgtggattttgcgttggtgtcacgacttagttaaacactggggagctggatagaccccgcggggtggggccaagaggaaactgacaagtgcgcagctcttagagtcagtcaggtatcccgacactgcatccttccctacagccttgcttcgagtcagggtgcctcgcaatgctcagcttcgcattgcttttcctcgtccctgccctgcatcaaccgcccagcagtttacaggccccgcatcccattcccgcatcctgaccccgcatcccaattctgcatccccgcctctccctcacaatcccacccctgccggccgtagctccaccgcccagcatcatcctgcccagagacagggttgcctgcaccttctccgacccgcgcagcttctcttaggagcttcccggctcgcaggcaggctgagtccgggtcttctccaagctcctcgcccctcggtccgtgttattcgctctattattcgtgtcctggagcccagctgactcctctatggacagaccccgctaaaagggaccagtcgatttaacaagtttccccagcagctgttagctgacagatctcattttaaagtgtttccttagcgcccggtcaaggacagctcgacttcgttcgtttcctctctgaggtctcagaactcccacccttctcccttactctctgcactcggacccctctatggtgaattacaggacttcttctttagcatcttgggaaacatccgagtttatttactaatttgaaaaacaagagattatccctcttcgagtctgaaaaaaaaatcgacgttaagtttgtacc

SEQ ID NO: 122603 - DNA, 151 bp, Homo sapiens; identical to SEQ ID NO: 90538
  chr3:158176209-158176360
  Hypo

SEQ ID NO: 122604 - DNA, 125 bp, Homo sapiens; identical to SEQ ID NO: 90539
  chr3:158288887-158289012
  Hyper

SEQ ID NO: 122605 - DNA, 252 bp, Homo sapiens
  chr3:158449947-158450199
  Hyper
acctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggc

SEQ ID NO: 122606 - DNA, 55 bp, Homo sapiens; identical to SEQ ID NO: 90541
  chr3:158450408-158450463
  Hyper

SEQ ID NO: 122607 - DNA, 30 bp, Homo sapiens; identical to SEQ ID NO: 90542
  chr3:159444029-159444059
  Hypo

SEQ ID NO: 122608 - DNA, 44 bp, Homo sapiens; identical to SEQ ID NO: 90543
  chr3:159480931-159480975
  Hyper

SEQ ID NO: 122609 - DNA, 58 bp, Homo sapiens; identical to SEQ ID NO: 90544
  chr3:159482848-159482906
  Hyper

SEQ ID NO: 122610 - DNA, 71 bp, Homo sapiens; identical to SEQ ID NO: 90545
  chr3:159483270-159483341
  Hyper

SEQ ID NO: 122611 - DNA, 30 bp, Homo sapiens; identical to SEQ ID NO: 90546
  chr3:159751507-159751537
  Hypo

SEQ ID NO: 122612 - DNA, 300 bp, Homo sapiens; identical to SEQ ID NO: 90547
  chr3:159756632-159756932
  Hyper

SEQ ID NO: 122613 - DNA, 1147 bp, Homo sapiens; identical to SEQ ID NO: 90548
  chr3:159943489-159944636
  Hyper

SEQ ID NO: 122614 - DNA, 565 bp, Homo sapiens
  chr3:160167468-160168033
  Hyper
caccttctccgcatccgtaaaggtccttagactcaccgcggggaggaagcggaccaggcaactccacagcacggaaacacagcgccacgagctccaggcggatgctgagagccgccccgagtccccgccctcctctgccccgaagggcttcaggtgcccagaccgggcggggcctcgcggagcctcgcagcgcaggcgcagtctgcaggcaacattcaactgcaaggcatcggccaatgggaactattgctgggctcgttcgaaagtaaacggtggacggcgcggcccgaggcaggtggcgggagtcagtttaaggctggcgcccagctttccgcgcctgcgtgctaggcgcaggccgcctctcggaagcttggcctcgcaggagcggctctctatcctgtggggagcttcggccagtgggcctcgtgagctggggtcccgcctggggaatccgcatggcaccggtggtctgggggagaggctgggcctggcgcgggacgaggcgaagcgccggtggccgacggcttctgaggaattatcttttacttggcgccacacggggcgg

SEQ ID NO: 122615 - DNA, 48 bp, Homo sapiens; identical to SEQ ID NO: 90550
  chr3:160170146-160170194
  Hypo

SEQ ID NO: 122616 - DNA, 36 bp, Homo sapiens; identical to SEQ ID NO: 90551
  chr3:160474464-160474500
  Hyper

SEQ ID NO: 122617 - DNA, 196 bp, Homo sapiens; identical to SEQ ID NO: 90552
  chr3:160822766-160822962
  Hyper

SEQ ID NO: 122618 - DNA, 540 bp, Homo sapiens; identical to SEQ ID NO: 90553
  chr3:161090003-161090543
  Hyper

SEQ ID NO: 122619 - DNA, 30 bp, Homo sapiens; identical to SEQ ID NO: 90555
  chr3:163720280-163720310
  Hypo

SEQ ID NO: 122620 - DNA, 137 bp, Homo sapiens; identical to SEQ ID NO: 28538
  chr3:164911621-164911758
  Hyper

SEQ ID NO: 122621 - DNA, 87 bp, Homo sapiens; identical to SEQ ID NO: 90557
  chr3:164912404-164912491
  Hyper

SEQ ID NO: 122622 - DNA, 1578 bp, Homo sapiens
  chr3:164912907-164914485
  Hyper
aacaaataattaaaacgctgcatcattcattttctgaagagctttgagccgtctatagagccttttctaatctgctgtcgtcaggcgaaacgcacaatggtctgtttagaaacggaaaattattaaaagctcaagcctttttccttctacctcttacaacaccagcgagcattccactgggggaggggtccttcgctccgccacctggcctatttgttggagttacttacgatgtcttcacccagaaaagaggtccgagggtatgttagtctccggtacccctccttccaccaacgtccttacacctaactgatccaattcaaaactgcaacaaacccctagcacctgtgagcgtacagaatacaccgcggccaaactcgatgtgctctacaatgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaattagcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacgtctcctcctaaactggagcgccaggtcgtgtataaggagtcaatataggaaacgcagggctggaacctgaatgcaaatccatcagccgcccccaaatcgcg

SEQ ID NO: 122623 - DNA, 461 bp, Homo sapiens; identical to SEQ ID NO: 90560
  chr3:164914796-164915257
  Hyper

SEQ ID NO: 122624 - DNA, 91 bp, Homo sapiens; identical to SEQ ID NO: 90566
  chr3:166984418-166984509
  Hypo

SEQ ID NO: 122625 - DNA, 91 bp, Homo sapiens; identical to SEQ ID NO: 90567
  chr3:166984569-166984660
  Hypo

SEQ ID NO: 122626 - DNA, 275 bp, Homo sapiens; identical to SEQ ID NO: 90568
  chr3:167097912-167098187
  Hyper

SEQ ID NO: 122627 - DNA, 33 bp, Homo sapiens; identical to SEQ ID NO: 90570
  chr3:167916958-167916991
  Hypo

SEQ ID NO: 122628 - DNA, 315 bp, Homo sapiens; identical to SEQ ID NO: 90571
  chr3:167966606-167966921
  Hyper

SEQ ID NO: 122629 - DNA, 114 bp, Homo sapiens; identical to SEQ ID NO: 90572
  chr3:167967446-167967560
  Hyper

SEQ ID NO: 122630 - DNA, 445 bp, Homo sapiens; identical to SEQ ID NO: 90573
  chr3:167967937-167968382
  Hyper

SEQ ID NO: 122631 - DNA, 30 bp, Homo sapiens; identical to SEQ ID NO: 90574
  chr3:168118785-168118815
  Hypo

SEQ ID NO: 122632 - DNA, 30 bp, Homo sapiens; identical to SEQ ID NO: 90575
  chr3:168156757-168156787
  Hypo

SEQ ID NO: 122633 - DNA, 56 bp, Homo sapiens; identical to SEQ ID NO: 90576
  chr3:168427120-168427176
  Hypo

SEQ ID NO: 122634 - DNA, 30 bp, Homo sapiens; identical to SEQ ID NO: 40048
  chr3:168490451-168490481
  Hypo

SEQ ID NO: 122635 - DNA, 47 bp, Homo sapiens; identical to SEQ ID NO: 28546
  chr3:168864015-168864062
  Hyper

SEQ ID NO: 122636 - DNA, 40 bp, Homo sapiens; identical to SEQ ID NO: 90579
  chr3:168864583-168864623
  Hyper

SEQ ID NO: 122637 - DNA, 35 bp, Homo sapiens; identical to SEQ ID NO: 90580
  chr3:168865068-168865103
  Hyper

SEQ ID NO: 122638 - DNA, 254 bp, Homo sapiens; identical to SEQ ID NO: 90584
  chr3:168960226-168960480
  Hyper

SEQ ID NO: 122639 - DNA, 885 bp, Homo sapiens; identical to SEQ ID NO: 90587
  chr3:169375895-169376780
  Hyper

SEQ ID NO: 122640 - DNA, 959 bp, Homo sapiens
  chr3:169378686-169379645
  Hyper
ctggagtagtgcaagcgggaatctgaggctcagtaaaagtttgtaagagttgagatctagctatcagaaagcggcagcggcatccttagagaccctggggacaaaataaatgggtctcccaccagttgaatgacaagtatcatcagatcggaaacgaggctcagtttctggatgctgagtggactgtgcgtgcgggaatattttaagacggcatcgtatgtcttgcttggcaattaaaatagttgaaaaagttgctcaagaaaattcgaagggttttgtgttctgctttcacttcagaagttatcgggcagtgagttgcggcgcgaagccttaagctttcacttcacaacttaggcatggttgaaaagggctacccacccccacccaccatcccactcccgccaactcccccccccacacacacactctctctctctcccaacctttagtccaaatcgaagcccgcaaacctcaagtatatgtacatttatttcccttcagatgaaaataaagacatcggcctcatttaaaagcaaacagggaaaacagttccaccggcgccctttgacactgtagcagcgagtgtaaagaacaacacccaaaagagaaacagatggactgatgacccaaagagccctatatttaggttgatttctcagacccaggggaaaggaaatgtatcggggagtgtacgagtgcttgggtgaggactgcacaaagcactggaaaggcgcctgggatgacagcatctcgcggggctacaccgccgactccaatgcccgcgaagccgagcctgctgaggtgccgccgacttcccgggctgctgcagggacgcagtgagcaaggaggcgtggatacgatacctaccgtatttggttctaatgtgcgagggtcgcgcggggggagactgggatttcactggggagaagcatcccacccatctccgatctctcatttct

SEQ ID NO: 122641 - DNA, 89 bp, Homo sapiens; identical to SEQ ID NO: 90589
  chr3:169386544-169386633
  Hyper

SEQ ID NO: 122642 - DNA, 114 bp, Homo sapiens; identical to SEQ ID NO: 90590
  chr3:169427251-169427365
  Hypo

SEQ ID NO: 122643 - DNA, 36 bp, Homo sapiens; identical to SEQ ID NO: 90591
  chr3:169480922-169480958
  Hyper

SEQ ID NO: 122644 - DNA, 30 bp, Homo sapiens; identical to SEQ ID NO: 90592
  chr3:169482409-169482439
  Hyper

SEQ ID NO: 122645 - DNA, 466 bp, Homo sapiens
  chr3:169482680-169483146
  Hyper
ttgctctagaatgaacggtggaaggcggcaggccgaggcttttccgcccgctgaaagtcagcgagaaaaacagcgcgcggggagcaaaagcacggcgcctacgcccttctcagttagggttagacaaaaaatggccaccacccctcccaggcccaccctccgcaacccggtgcgctgccgggcgagtcggcttataaagggagcggccgccgaccgcacggattggccaagctgactctcgcggctctcgtgagagtcactctctcgggcgggctggttggggggaacgggaaattaaagttccatttccggccatgaggaaggacgttgcccttccgcacgtccgggaaaggctttgcgtctttacttccgaccttctttaaaggtgaaactaacttgaggtatcagagggccttttttctatcctctgcagaccagacgcggttcacctcgactaccttaaaaa

SEQ ID NO: 122646 - DNA, 105 bp, Homo sapiens; identical to SEQ ID NO: 90595
  chr3:169485356-169485461
  Hypo

SEQ ID NO: 122647 - DNA, 250 bp, Homo sapiens; identical to SEQ ID NO: 90596
  chr3:169487251-169487501
  Hyper

SEQ ID NO: 122648 - DNA, 463 bp, Homo sapiens; identical to SEQ ID NO: 90598
  chr3:169529938-169530401
  Hyper

SEQ ID NO: 122649 - DNA, 711 bp, Homo sapiens; identical to SEQ ID NO: 90599
  chr3:169539898-169540609
  Hypo

SEQ ID NO: 122650 - DNA, 154 bp, Homo sapiens; identical to SEQ ID NO: 90600
  chr3:169540980-169541134
  Hypo

SEQ ID NO: 122651 - DNA, 19 bp, Homo sapiens
  chr3:169579288-169579307
  Hypo
agagcgagactccgtctca

SEQ ID NO: 122652 - DNA, 30 bp, Homo sapiens; identical to SEQ ID NO: 90602
  chr3:169900402-169900432
  Hypo

SEQ ID NO: 122653 - DNA, 22 bp, Homo sapiens
  chr3:169980664-169980686
  Hypo
accttcttttgtggccgggcgc

SEQ ID NO: 122654 - DNA, 30 bp, Homo sapiens; identical to SEQ ID NO: 90605
  chr3:170025781-170025811
  Hypo

SEQ ID NO: 122655 - DNA, 420 bp, Homo sapiens; identical to SEQ ID NO: 90606
  chr3:170136627-170137047
  Hyper

SEQ ID NO: 122656 - DNA, 58 bp, Homo sapiens
  chr3:170137436-170137494
  Hyper
ccgcccggcctcccccggggcgccgagccttcgcgttaggttccgcccgcagaggtga

SEQ ID NO: 122657 - DNA, 30 bp, Homo sapiens
  chr3:170137698-170137728
  Hyper
catctccgctgcccccgctacccccgcccc

SEQ ID NO: 122658 - DNA, 32 bp, Homo sapiens; identical to SEQ ID NO: 90607
  chr3:170266977-170267009
  Hypo

SEQ ID NO: 122659 - DNA, 1444 bp, Homo sapiens
  chr3:170302487-170303931
  Hyper
gagaactttcagcaccgcggacagcgccattccctgcactcagtcggaggaggagagctaccttgcccccagcgctctcctagaccctatacctagggggaggcagggtgacatcctgcggcccttgggcaattcgggccagtgacgttcaccgacactcaggcggggatcccttcgccagagccagttcctttgagtgtctccgctcaaaatctcaaggaaacgagcttcacacaggtggggggatgaggagtgccagaacaggagcgagccccgctgctctagccttcctgcatctcttctcgcctttgctttgctcactcttcaatcgcaatataaaatactcatttggggagggggcagggtgacacaggagagagaaggagggtgggggctgcatcccgcgtggccacgcagccctaacctggccctcttggattagaggggagctgatgtgctttggaatgggagaagagaggagactgagggttgaagcagtgcaggagagctccccttgctggggctgccggctctgggcagggagcttccctggacaccgctcccgtcacgtcctcttcgccgctcccgggagagtcaccactctccggggacagacgcccctcggggcgccaccatcctggtcggggtgctgggctcggcgggagtccctttgaggagtttgctcccaggtaaaagggcagacgttgctcccgacctccccggagtctgcggccggaaaagcgtctccgtttcatggtctcggtccgaggcggagaacggagctgcccgtgcggggtgcgcgccaaggcgggggacaggacgggcccggcgtctgccgagacctaggctgcccgcattccgctcgcggctccccttctgcctcccgctctagcggcgccggagccgcgctggcccccgccccgcccggcagctcccgcgagtcagagcccggtgcccccagaccgcgggcagtcggggcctcattccgggccagagcaggaaagagcccgacccacctcctcggttcttccagggaaccccttctcggagggcgccctgggcctccgcgccatattcctggtcccccgctcccggtgactccggctccctgggtcattccgggagaggcggccatcccagttgcaggggtcccgctggggcgcggggggcgcggagggggacaaacggcagcgaagggggccgttcacttaccggggtcggggctggaggcgacgagctggctgccaaggctggtggctggcagtccgcacttactgcgcggagctgtctctctagctgggatgggaagtggtggtggcggcaaaggaaggcaggaggcagccgctgctgctgaacagctcctcaattattcagattgggcccccaccccccgaacccctccccgtgcctgctcgtcctccctccagctcgcctgtctccgcct

SEQ ID NO: 122660 - DNA, 109 bp, Homo sapiens; identical to SEQ ID NO: 90612
  chr3:170583189-170583298
  Hypo

SEQ ID NO: 122661 - DNA, 346 bp, Homo sapiens; identical to SEQ ID NO: 28560
  chr3:170625828-170626174
  Hyper

SEQ ID NO: 122662 - DNA, 254 bp, Homo sapiens; identical to SEQ ID NO: 90614
  chr3:170626456-170626710
  Hyper

SEQ ID NO: 122663 - DNA, 18 bp, Homo sapiens
  chr3:170627856-170627874
  Hypo
atccggccactgtactcc

SEQ ID NO: 122664 - DNA, 20 bp, Homo sapiens
  chr3:170831096-170831116
  Hypo
tataaaatgctaattcggcc

SEQ ID NO: 122665 - DNA, 30 bp, Homo sapiens; identical to SEQ ID NO: 90617
  chr3:170957950-170957980
  Hypo

SEQ ID NO: 122666 - DNA, 30 bp, Homo sapiens; identical to SEQ ID NO: 90618
  chr3:171036849-171036879
  Hypo

SEQ ID NO: 122667 - DNA, 30 bp, Homo sapiens; identical to SEQ ID NO: 90619
  chr3:171095156-171095186
  Hypo

SEQ ID NO: 122668 - DNA, 30 bp, Homo sapiens; identical to SEQ ID NO: 90620
  chr3:171139798-171139828
  Hypo

SEQ ID NO: 122669 - DNA, 30 bp, Homo sapiens; identical to SEQ ID NO: 90621
  chr3:171147897-171147927
  Hypo

SEQ ID NO: 122670 - DNA, 283 bp, Homo sapiens; identical to SEQ ID NO: 90622
  chr3:171528050-171528333
  Hyper

SEQ ID NO: 122671 - DNA, 27 bp, Homo sapiens
  chr3:171661628-171661655
  Hypo
cgtgagcctccgcgcccagcctgagaa

SEQ ID NO: 122672 - DNA, 145 bp, Homo sapiens; identical to SEQ ID NO: 40054
  chr3:172033174-172033319
  Hypo

SEQ ID NO: 122673 - DNA, 2485 bp, Homo sapiens
  chr3:172165432-172167917
  Hyper
gttctggtccctgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgctcgacgctcagcgctgtgatggtgagcaccgtggcgtaggtgcagctctcactgacgaattggaagagtttgcagaggaggtcgccgaagttccagggccggtactgccagaggcgaacgaggtccaggggcatgcagaggaagatgagcagatcggagaaggccatgctggacaggtagaggttggtggtggtgcgcagctcgcggaagcgcgacaccaccagcatggtgagcaggttgccagcgatgcccaccacgaagagtgccacgcaggtggctgtgacgcccgccagcagcggcgcggggaagagctgcagcagctcgtcgcccagcgagtcgttgccgggggaagcatcccagtccaggtcggccagtgtgaggttgaaccccggctcttcgctgggcgtcgcgttccacatgctgccggctcagctgaacaggctctgggacgtgactgcgctgggaggctggaccgagctggctcccgaggaggtccgcttaggcgcgggagggtgcgagggaggagcgggtgcagacgcgtagggaggatgcttggagaagaaagagagggaggtgagaggcagaagccgaggaagaaggtgagatggggacaaggaagagggagagagactggtggtcagtgggtgagagagtgacccactgctttctctgacacctcccctttcccccaccaactcccccaaagtttctcccaacacatcctccggccggcgcccacacgcatacctgtcaccagccctgcctcgcatttgcgttctcgatccagttccatctcgcacttcccaaagcgtcgcagcgagtggggaccgcagggaccaggcgccgcgaagcgggagcgtgaggcgctctctccgaagccctgggcgacgctggactagtgtgccccggaaggacaggtcacacccgggggtgggggtgaagacgacggtggcggtggggaggacacctttagcagctgggacctgatttcttcctccacaaggctgcagctggctatggccctggtggaaagaaaaagcgagcttgaccaactcgacttgggaagggggatagagagagaaaagaaggaccttgtgtttgtattcataccggtgagcaccaaagaatagtctcacgcagttataggacccaggttcagcgatgtgactacttgtccaaggtcacacagcgagctggggactcggggaccagtgtcggatctcccacccggttgggacttctgagcgcacaggggcaagatatgtgagtaaaccctgtccagaatcccagtcctttgtatcactcggtagtggtagagagtctgctgtagggtatattacttttgcttgatgcaaacctggtggcggggtgccgaggttggtcagggagggaacaggagaaaggaaaaaggcagggttggaggtgtgtggaggcggcaagtgaagaagaggctgtgaggctggcgcgtcgagagtgtgcaggaaacattttttgaggcataactgagagagatcagccatttagtagccgtattcccttgggcaaggtcttcaacctcctgagcattacgtctttttctttgaattgcaatgatttgtgcggaccactgggggtgatatcaagtgtcagggaccaccggaggcactcaataaatagaagacgcgttgctgttgagaagtagaagctgtgccggtgggaacaggtcaaaggccacccctacactagcaaggtgaccctctggacgcggtctgtgcgtctcctgctcagagccagaaatcagcacccgaaggcatgagactgccagttgccagcgaattcacaaatccgaccggcccctcccggcccaccgacctcgggaccgccccaggaacatattcagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcct

SEQ ID NO: 122674 - DNA, 30 bp, Homo sapiens; identical to SEQ ID NO: 90631
  chr3:172263919-172263949
  Hypo

SEQ ID NO: 122675 - DNA, 37 bp, Homo sapiens; identical to SEQ ID NO: 90632
  chr3:172355768-172355805
  Hypo

SEQ ID NO: 122676 - DNA, 16 bp, Homo sapiens
  chr3:172356006-172356022
  Hypo
gcagtgagctgagatc

SEQ ID NO: 122677 - DNA, 58 bp, Homo sapiens; identical to SEQ ID NO: 14590
  chr3:172384961-172385019
  Hypo

SEQ ID NO: 122678 - DNA, 22 bp, Homo sapiens
  chr3:172395425-172395447
  Hypo
ttggtgggggaggggcgggggg

SEQ ID NO: 122679 - DNA, 30 bp, Homo sapiens; identical to SEQ ID NO: 90636
  chr3:172424700-172424730
  Hypo

SEQ ID NO: 122680 - DNA, 35 bp, Homo sapiens; identical to SEQ ID NO: 90637
  chr3:172425347-172425382
  Hypo

SEQ ID NO: 122681 - DNA, 35 bp, Homo sapiens; identical to SEQ ID NO: 90638
  chr3:172425682-172425717
  Hypo

SEQ ID NO: 122682 - DNA, 225 bp, Homo sapiens; identical to SEQ ID NO: 90639
  chr3:172466199-172466424
  Hypo

SEQ ID NO: 122683 - DNA, 31 bp, Homo sapiens; identical to SEQ ID NO: 40058
  chr3:172469925-172469956
  Hypo

SEQ ID NO: 122684 - DNA, 31 bp, Homo sapiens; identical to SEQ ID NO: 40059
  chr3:172470196-172470227
  Hypo

SEQ ID NO: 122685 - DNA, 30 bp, Homo sapiens; identical to SEQ ID NO: 90642
  chr3:172550135-172550165
  Hypo

SEQ ID NO: 122686 - DNA, 284 bp, Homo sapiens; identical to SEQ ID NO: 90643
  chr3:172727266-172727550
  Hypo

SEQ ID NO: 122687 - DNA, 44 bp, Homo sapiens; identical to SEQ ID NO: 90644
  chr3:172727610-172727654
  Hypo

SEQ ID NO: 122688 - DNA, 116 bp, Homo sapiens; identical to SEQ ID NO: 90645
  chr3:172858974-172859090
  Hypo

SEQ ID NO: 122689 - DNA, 604 bp, Homo sapiens; identical to SEQ ID NO: 90646
  chr3:173113090-173113694
  Hyper

SEQ ID NO: 122690 - DNA, 451 bp, Homo sapiens; identical to SEQ ID NO: 90647
  chr3:173114136-173114587
  Hyper

SEQ ID NO: 122691 - DNA, 709 bp, Homo sapiens; identical to SEQ ID NO: 28571
  chr3:173114985-173115694
  Hyper

SEQ ID NO: 122692 - DNA, 218 bp, Homo sapiens; identical to SEQ ID NO: 90649
  chr3:173115957-173116175
  Hyper

SEQ ID NO: 122693 - DNA, 814 bp, Homo sapiens
  chr3:173302411-173303225
  Hyper
agccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggtaagtttgtggctcttttattgggagggggctgccagggttttgtgccactgcgcggaaggtgatgcggacgcggtgcctgtgaaatggagagagaaaggggaatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggcttctagggg

SEQ ID NO: 122694 - DNA, 36 bp, Homo sapiens; identical to SEQ ID NO: 90653
  chr3:174159270-174159306
  Hyper

SEQ ID NO: 122695 - DNA, 37 bp, Homo sapiens; identical to SEQ ID NO: 90655
  chr3:175338134-175338171
  Hypo

SEQ ID NO: 122696 - DNA, 31 bp, Homo sapiens; identical to SEQ ID NO: 90656
  chr3:176545097-176545128
  Hypo

SEQ ID NO: 122697 - DNA, 30 bp, Homo sapiens; identical to SEQ ID NO: 90657
  chr3:176837181-176837211
  Hypo

SEQ ID NO: 122698 - DNA, 206 bp, Homo sapiens; identical to SEQ ID NO: 90658
  chr3:176853680-176853886
  Hypo

SEQ ID NO: 122699 - DNA, 24 bp, Homo sapiens
  chr3:176869535-176869559
  Hypo
tttcccagacgggcacggtggctc

SEQ ID NO: 122700 - DNA, 17 bp, Homo sapiens
  chr3:176871397-176871414
  Hypo
aggcgcggtggctcacg

SEQ ID NO: 122701 - DNA, 41 bp, Homo sapiens; identical to SEQ ID NO: 40063
  chr3:176872455-176872496
  Hypo

SEQ ID NO: 122702 - DNA, 197 bp, Homo sapiens; identical to SEQ ID NO: 90662
  chr3:176897068-176897265
  Hypo

SEQ ID NO: 122703 - DNA, 30 bp, Homo sapiens; identical to SEQ ID NO: 90663
  chr3:177158305-177158335
  Hypo

SEQ ID NO: 122704 - DNA, 28 bp, Homo sapiens
  chr3:178577720-178577748
  Hypo
aaacaaaataaagttcggaaggggagcc

SEQ ID NO: 122705 - DNA, 30 bp, Homo sapiens; identical to SEQ ID NO: 90665
  chr3:178833103-178833133
  Hypo

SEQ ID NO: 122706 - DNA, 34 bp, Homo sapiens; identical to SEQ ID NO: 40066
  chr3:178861413-178861447
  Hypo

SEQ ID NO: 122707 - DNA, 30 bp, Homo sapiens; identical to SEQ ID NO: 90667
  chr3:179031625-179031655
  Hypo

SEQ ID NO: 122708 - DNA, 30 bp, Homo sapiens; identical to SEQ ID NO: 40067
  chr3:179136841-179136871
  Hypo

SEQ ID NO: 122709 - DNA, 979 bp, Homo sapiens; identical to SEQ ID NO: 90669
  chr3:179168661-179169640
  Hyper

SEQ ID NO: 122710 - DNA, 23 bp, Homo sapiens
  chr3:179171196-179171219
  Hypo
accgatcccggccccatattctt

SEQ ID NO: 122711 - DNA, 30 bp, Homo sapiens; identical to SEQ ID NO: 90671
  chr3:179183022-179183052
  Hypo

SEQ ID NO: 122712 - DNA, 184 bp, Homo sapiens; identical to SEQ ID NO: 90672
  chr3:179740682-179740866
  Hypo

SEQ ID NO: 122713 - DNA, 1194 bp, Homo sapiens
  chr3:179754178-179755372
  Hyper
cccttctcccaccttcggaaaccggtctagttttcccggcagcaccggacagaaatgtcacggtcatgttgcatcacttcacttgttgagctgtgcgaaggcagcacttgaccacagaaacttggtgaaccgccttgctcttaaattagcccccaagaattctctccagccctatagaaatgtcttacctgcatgtgtccctggtacattctgcttcggtttcttcagggctccctgaggccaccggatgcttttcccccgtgcttacttgcccaccaaaagaggggaaaaggtgggtgcacagcgggttctcagagggtgctcctgagccccctggagctccgggtactcggccggccggcggccactcggcagcgctgcgggctgccgggaactgttctccgctcggggtgctgaaagcggacgcgggagagcgcgcagagaaggcgaggagccgggtcggccaggctctcctgcaggcgcgggtcctgctcgcggggcgtctctagaactcactccttcttcgccgaactctttctcgcttcctgccaggttgcctcatgtctctctctctctgagctgcgaaccccctcctcccagccctgacgtgagcgcctacaccagccgccgccgcagctgccgagcggggcgcgcgccgttctcccagccgcgtgcctgccgagaggccgcgggaccgggcacgcgcgcgcgttcccaggggcctgggagcggcccgagggcggccccgggcggtgcgcgctccccgagcgcgtcctcggggctgcgcgcgcgcggcggcaaggcgaggtgccggcaggcggtggtcgcgctggtgtacaacgcccgcagcagcgcggcgttcaggtgcggcgtcggcgggcagggcgattctagcggagaggatggccggccggaagaaaggcgggaagacatgcatcgtctctccgggggccatccaccgcggctgagcctgttatcctacagacattataggctgagtgcaggggttgccgaagagtttacttcggttctgattcagctctcgaaagttacgtccgtatcacccgttaaataaagactccccgctcccctcatccccagttcatcgccgagcattctatttaaaacggcaaaccctagtccctgaggatctggcatgttttatttttttccctagcacgtaacatcacctaa

SEQ ID NO: 122714 - DNA, 30 bp, Homo sapiens; identical to SEQ ID NO: 40070
  chr3:180042862-180042892
  Hypo

SEQ ID NO: 122715 - DNA, 87 bp, Homo sapiens; identical to SEQ ID NO: 90679
  chr3:180319834-180319921
  Hyper

SEQ ID NO: 122716 - DNA, 732 bp, Homo sapiens; identical to SEQ ID NO: 28581
  chr3:180397310-180398042
  Hyper

SEQ ID NO: 122717 - DNA, 121 bp, Homo sapiens; identical to SEQ ID NO: 90681
  chr3:180547113-180547234
  Hypo

SEQ ID NO: 122718 - DNA, 1286 bp, Homo sapiens
  chr3:181413144-181414430
  Hyper
cctcggagcagcccacgagcccgtgaaggcgcgtggggaaggggggcctggaaagcccgggcttcgactcactcggccagtaccgctccgaggaggggcctcagcctccttcggagccagggccgcgcccgagccgcgctaggccagggggccggacgcgcacggaagggggctggcggacacggccgggtggtggcgcagttcctgggggcacagggcagcccagcccgccggcccgcgcctccgcttccccactccagcgaaactggacaaggccgacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggtcattggctccctggaacatccagaccctgatcgtgcgtatcgtgtttccttataagcagcactcgcgatttaaaaacaggtcccggtgcccctcttgctgatcctctctgccattagcccgcttaattccctttttgtaaattcccctctttacctttctttcgtccctccctccctctctttcttctttcctcctctccttttcccctttctctttttcttcctcaatctaggtcgtttctgctgaatgatatttattcaccgaagtcccaatctg

SEQ ID NO: 122719 - DNA, 99 bp, Homo sapiens; identical to SEQ ID NO: 90683
  chr3:181419696-181419795
  Hyper

SEQ ID NO: 122720 - DNA, 638 bp, Homo sapiens; identical to SEQ ID NO: 90684
  chr3:181419915-181420553
  Hyper

SEQ ID NO: 122721 - DNA, 1926 bp, Homo sapiens; identical to SEQ ID NO: 90685
  chr3:181421249-181423175
  Hyper

SEQ ID NO: 122722 - DNA, 568 bp, Homo sapiens; identical to SEQ ID NO: 90686
  chr3:181428260-181428828
  Hyper

SEQ ID NO: 122723 - DNA, 111 bp, Homo sapiens; identical to SEQ ID NO: 90687
  chr3:181429607-181429718
  Hyper

SEQ ID NO: 122724 - DNA, 277 bp, Homo sapiens; identical to SEQ ID NO: 90688
  chr3:181430054-181430331
  Hyper

SEQ ID NO: 122725 - DNA, 721 bp, Homo sapiens; identical to SEQ ID NO: 90689
  chr3:181430695-181431416
  Hyper

SEQ ID NO: 122726 - DNA, 503 bp, Homo sapiens
  chr3:181437066-181437569
  Hyper
gctggaggtgtccttcgttttattaccctagtctgcctgcgtgtacagaatgaagggtgcactgttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgacgagctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagccctctccatgttgacctcgtgacacgggagacggtgtct

SEQ ID NO: 122727 - DNA, 270 bp, Homo sapiens; identical to SEQ ID NO: 90692
  chr3:181438167-181438437
  Hyper

SEQ ID NO: 122728 - DNA, 3982 bp, Homo sapiens
  chr3:181440785-181444767
  Hyper
gaccttccaagagttcgttttacatttgttgaagcccaggccttggtgcctcaagttttaaatggaattactcaaggggggcacactactagacaaactattctagccaattccttcatccccgacccagtccctactcctctctgcccccgcccacttcgccacttcttagtcccggatctgaacattttagctgaaagagggaggggtgaggaaagggccaggacagttccctcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaacatgcgtacacacacttgcactcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttctttctagacagtgttgtggaggaagaacaatgaagatctaattgtggagatttcataagttggctcccgtaaatgaacagcttagatatggaagttccagcagatgtgggtactattcgcctctacaagctctaccccccacccccatatacgcagtccaaacactctattggagggttttttttttttttttttttttgtggtggtggtggtcctcagatcctagcaaccacctaaagtttccagtagtaattagagcttttatcgggcttgctcttcagccctttatattgccgatttagcgttaaggcattaagtccacacaccaaattagcgcgactcccaaatagccacaaccacttattctccccttccctcattttggtggttggacaccaagagcatgggcctgggacttttttttttttttttttttttggttttactttgttttgatttgatttttaaaacctattcgctaccgcactgtcttggaatatacttgtttcaggcagagttttgcaagggacctgagccattattttgcaaacgcctggaagagcacatgaaactcagagaactacaatgcagacgacaacgcctagaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccactctctttctcaggacctaaaaagtgacggggagagggtgaagaattggagaaagcagcggattttcaaaacgtatcccccccgcccccccatcttttaaagtagtatgttaccacaaggagtgcatttgggaaactttccctaacaggagctgggcgcagtgttattcttctccatgggtctgctggcctccccgcccccgctggacaatgcgtgctttgagactcggtggcctgcaggcagcgggagacgaggggactgggcagccttcctccaaggggcccgcagctgggggagcgccaggcagggagcagggacaaggaggcgagccacgcaggaaggaaaaccataaaagtgccattttttcccttagccctgcacagaggcaggctttgaggacctaggggcagggcagctggggcggggtggggtgggggtgttgagaggttttgcgtgttctttttaccccctttccccccactgaaacattttatttcggcacataattatgcactgcagattctccagcctcctcgccctcaatcttggtaacctggtctttggttaataatatcgcaactcgggacttcaacgctcagaccccctccaggccccagcctccgtattctcggagccctccactactgatacctctcgcggagtgcggcgccccgggaaaagcctcttggccagggactctgggacattactttctagtttgttttgttttttgtttttctcccagagaccaccaccaccctcatcctcttcaggcagcatttaggagaggacctctgagatcagcagaaggcctcagacggtcaccatattggtggaagcgtttgtctgatgttttaaaacgtataccaaacggggcgtcagggccacgtgctgtgccttcgaaacgccgccgcgggccctgcctttcagagctgcggcagccggggctggcgtggagggggcgctgaaacaccggcgggcgtcaggggccagcgctgagctgcagatctggccgcagcgctgagtgaagcgaattatctggagcgtgtttgatctgggactgcgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgca

SEQ ID NO: 122729 - DNA, 1161 bp, Homo sapiens
  chr3:181444827-181445988
  Hyper
ttgcgtcttgcgcagcgcagacacctccactctggattgaaacgaaaaagctcgcggtaagagcagaaaattggtctattgatacattcgctccgagtgttgatcttggcatcaccgatagccggttaattcccccaccccgcccccgccagtgggtcgcacgcggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacctttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatccggacttgaatgtagattactctggcgatcgtttgatcggccctttgaaaccctttacaattgcctgtgacgaacggccagtctcagtttttctctgaataatccctgagggtaagtcctccgggcttttaaagagctctagtattttttttttaaagaataaaaagaaaaacgttcgattttagtttagacctcgtcaacttttagtcgctaacaggcatcactcaagccagtcaatacttaatgaccgttagttacccttg

SEQ ID NO: 122730 - DNA, 516 bp, Homo sapiens; identical to SEQ ID NO: 90701
  chr3:182314781-182315297
  Hypo

SEQ ID NO: 122731 - DNA, 20 bp, Homo sapiens
  chr3:182457888-182457908
  Hypo
agcctccgtggctggcgcgg

SEQ ID NO: 122732 - DNA, 21 bp, Homo sapiens
  chr3:182704506-182704527
  Hypo
agcaaatgggctgggcgcggt

SEQ ID NO: 122733 - DNA, 30 bp, Homo sapiens; identical to SEQ ID NO: 40073
  chr3:182800477-182800507
  Hypo

SEQ ID NO: 122734 - DNA, 19 bp, Homo sapiens
  chr3:182812783-182812802
  Hypo
tgccctggccaggcacggt

SEQ ID NO: 122735 - DNA, 148 bp, Homo sapiens; identical to SEQ ID NO: 90706
  chr3:182815981-182816129
  Hypo

SEQ ID NO: 122736 - DNA, 64 bp, Homo sapiens; identical to SEQ ID NO: 90707
  chr3:182834167-182834231
  Hyper

SEQ ID NO: 122737 - DNA, 34 bp, Homo sapiens; identical to SEQ ID NO: 90708
  chr3:182895956-182895990
  Hypo

SEQ ID NO: 122738 - DNA, 859 bp, Homo sapiens
  chr3:182896611-182897470
  Hyper
tgctgggaggcggaccgggagctcccagtctgcggcccccgccgggttggagcggctccggctcctccaaggctcgggctaagcggctctcaaccgattcccaccccgccctggagaaatgcgggcgtgtctgcaggcatttttgattgtcacgatttgggggcggggtggaggatggggtggcgcattcctggcacctagtgggtagaggccaggggtgctactaaacatcctaccgtgggagcacagagaagcccacgcagcaaagaattgcccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctggttgtcccctttctgccgccgccgaggctccggctgctttctgcgtagctgggcagggcccgggcccccacaccgcctctcccgggaatgcgggcgctctggagccgaggagcgggggcgtccgcagggaggtcagctctcctgggcggaggtcctcgggcgcagcgccctcgcctggaaaccagccgtcgcccccgcaggagccagccggcccgtggacgccccagcgcgctcctcctcggtgctgcgggtcgccctgcaattccgagaagaaagtcagagacgccgtggcccaaagaggcgcttagtctttcctcgctcacactcacgtttcctcctcatcgcgttcttctttttctccctggctgctttctcccctctccaggaaagcagatttggaggaacaggtttcgtgactgtcgtccgactggaaaa

SEQ ID NO: 122739 - DNA, 239 bp, Homo sapiens; identical to SEQ ID NO: 90711
  chr3:182971103-182971342
  Hyper

SEQ ID NO: 122740 - DNA, 531 bp, Homo sapiens; identical to SEQ ID NO: 90712
  chr3:182971927-182972458
  Hyper

SEQ ID NO: 122741 - DNA, 30 bp, Homo sapiens; identical to SEQ ID NO: 90713
  chr3:182987335-182987365
  Hypo

SEQ ID NO: 122742 - DNA, 121 bp, Homo sapiens; identical to SEQ ID NO: 90714
  chr3:182987831-182987952
  Hypo

SEQ ID NO: 122743 - DNA, 30 bp, Homo sapiens; identical to SEQ ID NO: 40078
  chr3:183035309-183035339
  Hypo

SEQ ID NO: 122744 - DNA, 36 bp, Homo sapiens; identical to SEQ ID NO: 90717
  chr3:183070301-183070337
  Hypo

SEQ ID NO: 122745 - DNA, 30 bp, Homo sapiens; identical to SEQ ID NO: 90718
  chr3:183084014-183084044
  Hypo

SEQ ID NO: 122746 - DNA, 247 bp, Homo sapiens; identical to SEQ ID NO: 90719
  chr3:183145371-183145618
  Hyper

SEQ ID NO: 122747 - DNA, 94 bp, Homo sapiens
  chr3:183145931-183146025
  Hyper
ctcgccacgccccgcgggggctcccgtgacagaccaagtctggcgctttcccagcgtcgcagctggaccgagagaggagcggccgttctgcaaa

SEQ ID NO: 122748 - DNA, 38 bp, Homo sapiens
  chr3:183146397-183146435
  Hyper
gacagtgactgaggcgctccagtcgcaccggggtccgg

SEQ ID NO: 122749 - DNA, 29 bp, Homo sapiens
  chr3:183146648-183146677
  Hyper
cagttcttgacctccgctggccacacctg

SEQ ID NO: 122750 - DNA, 43 bp, Homo sapiens; identical to SEQ ID NO: 90720
  chr3:183183687-183183730
  Hypo

SEQ ID NO: 122751 - DNA, 30 bp, Homo sapiens; identical to SEQ ID NO: 90721
  chr3:183196555-183196585
  Hypo

SEQ ID NO: 122752 - DNA, 84 bp, Homo sapiens; identical to SEQ ID NO: 90722
  chr3:183214546-183214630
  Hypo

SEQ ID NO: 122753 - DNA, 92 bp, Homo sapiens; identical to SEQ ID NO: 90723
  chr3:183355362-183355454
  Hypo

SEQ ID NO: 122754 - DNA, 141 bp, Homo sapiens; identical to SEQ ID NO: 90724
  chr3:183531359-183531500
  Hypo

SEQ ID NO: 122755 - DNA, 138 bp, Homo sapiens; identical to SEQ ID NO: 90725
  chr3:183543365-183543503
  Hyper

SEQ ID NO: 122756 - DNA, 99 bp, Homo sapiens; identical to SEQ ID NO: 90726
  chr3:183603067-183603166
  Hypo

SEQ ID NO: 122757 - DNA, 172 bp, Homo sapiens; identical to SEQ ID NO: 40081
  chr3:183622013-183622185
  Hypo

SEQ ID NO: 122758 - DNA, 274 bp, Homo sapiens; identical to SEQ ID NO: 90728
  chr3:183643321-183643595
  Hypo

SEQ ID NO: 122759 - DNA, 54 bp, Homo sapiens; identical to SEQ ID NO: 90729
  chr3:183648128-183648182
  Hypo

SEQ ID NO: 122760 - DNA, 79 bp, Homo sapiens; identical to SEQ ID NO: 90730
  chr3:183676026-183676105
  Hypo

SEQ ID NO: 122761 - DNA, 222 bp, Homo sapiens; identical to SEQ ID NO: 40083
  chr3:183684023-183684245
  Hypo

SEQ ID NO: 122762 - DNA, 30 bp, Homo sapiens; identical to SEQ ID NO: 90732
  chr3:183688570-183688600
  Hypo

SEQ ID NO: 122763 - DNA, 30 bp, Homo sapiens; identical to SEQ ID NO: 90733
  chr3:183696328-183696358
  Hypo

SEQ ID NO: 122764 - DNA, 34 bp, Homo sapiens; identical to SEQ ID NO: 40084
  chr3:183713864-183713898
  Hypo

SEQ ID NO: 122765 - DNA, 17 bp, Homo sapiens
  chr3:183728806-183728823
  Hypo
ggcgtgagccaccgtgc

SEQ ID NO: 122766 - DNA, 202 bp, Homo sapiens; identical to SEQ ID NO: 90736
  chr3:183771813-183772015
  Hypo

SEQ ID NO: 122767 - DNA, 35 bp, Homo sapiens; identical to SEQ ID NO: 90737
  chr3:183801986-183802021
  Hypo

SEQ ID NO: 122768 - DNA, 21 bp, Homo sapiens
  chr3:183872331-183872352
  Hypo
ttttttgggggggggcgaggg

SEQ ID NO: 122769 - DNA, 445 bp, Homo sapiens; identical to SEQ ID NO: 90739
  chr3:183948369-183948814
  Hyper

SEQ ID NO: 122770 - DNA, 26 bp, Homo sapiens
  chr3:183965599-183965625
  Hypo
cttactgtccaggcccgagttagaaa

SEQ ID NO: 122771 - DNA, 26 bp, Homo sapiens
  chr3:183965925-183965951
  Hypo
gccaccgcgcccggcagaaatgcatc

SEQ ID NO: 122772 - DNA, 105 bp, Homo sapiens; identical to SEQ ID NO: 90742
  chr3:183977991-183978096
  Hyper

SEQ ID NO: 122773 - DNA, 567 bp, Homo sapiens; identical to SEQ ID NO: 90743
  chr3:183980079-183980646
  Hyper

SEQ ID NO: 122774 - DNA, 209 bp, Homo sapiens; identical to SEQ ID NO: 90744
  chr3:183993757-183993966
  Hyper

SEQ ID NO: 122775 - DNA, 16 bp, Homo sapiens
  chr3:184005808-184005824
  Hypo
acaacgggagccaggc

SEQ ID NO: 122776 - DNA, 136 bp, Homo sapiens; identical to SEQ ID NO: 90746
  chr3:184015341-184015477
  Hypo

SEQ ID NO: 122777 - DNA, 16 bp, Homo sapiens
  chr3:184015597-184015613
  Hypo
gcgtggtggcacaaaa

SEQ ID NO: 122778 - DNA, 144 bp, Homo sapiens; identical to SEQ ID NO: 90748
  chr3:184016089-184016233
  Hypo

SEQ ID NO: 122779 - DNA, 149 bp, Homo sapiens; identical to SEQ ID NO: 40088
  chr3:184018038-184018187
  Hypo

SEQ ID NO: 122780 - DNA, 36 bp, Homo sapiens; identical to SEQ ID NO: 90750
  chr3:184031698-184031734
  Hypo

SEQ ID NO: 122781 - DNA, 41 bp, Homo sapiens; identical to SEQ ID NO: 90751
  chr3:184057516-184057557
  Hypo

SEQ ID NO: 122782 - DNA, 30 bp, Homo sapiens; identical to SEQ ID NO: 90752
  chr3:184059863-184059893
  Hypo

SEQ ID NO: 122783 - DNA, 23 bp, Homo sapiens
  chr3:184152655-184152678
  Hypo
actgtgcccggccagaatgtcct

SEQ ID NO: 122784 - DNA, 35 bp, Homo sapiens; identical to SEQ ID NO: 90754
  chr3:184164708-184164743
  Hypo

SEQ ID NO: 122785 - DNA, 130 bp, Homo sapiens; identical to SEQ ID NO: 90755
  chr3:184200600-184200730
  Hypo

SEQ ID NO: 122786 - DNA, 30 bp, Homo sapiens; identical to SEQ ID NO: 40091
  chr3:184226786-184226816
  Hypo

SEQ ID NO: 122787 - DNA, 86 bp, Homo sapiens; identical to SEQ ID NO: 90757
  chr3:184237219-184237305
  Hypo

SEQ ID NO: 122788 - DNA, 401 bp, Homo sapiens; identical to SEQ ID NO: 90758
  chr3:184243074-184243475
  Hyper

SEQ ID NO: 122789 - DNA, 35 bp, Homo sapiens; identical to SEQ ID NO: 90759
  chr3:184279894-184279929
  Hyper

SEQ ID NO: 122790 - DNA, 51 bp, Homo sapiens; identical to SEQ ID NO: 90760
  chr3:184280171-184280222
  Hyper

SEQ ID NO: 122791 - DNA, 352 bp, Homo sapiens
  chr3:184301488-184301840
  Hyper
cccacggagcccagccgcgccgccgcagccggcccgggggaggggcgccccgcacggctaagctctctgcgtccccggggcggacgcggggaggggaggggaagggacgcagcctctccgccgaggcctccttcctcccctagtgggggggaggggctgtgcgggggcaggggcgggcgatgcgggggcccaaggtggcccttggactaggcgccggagctgtcaacggggcgaggtgtggcgggcggccgggggaggggacgcggtgccgagtggcctcctgcacagccgctcagcattccccggctgcaggcgcaaataaagcggagggggcgcgcggagctcctgctca

SEQ ID NO: 122792 - DNA, 306 bp, Homo sapiens
  chr3:184319790-184320096
  Hyper
tacaggggcagcagccgcggctggcggcttcggggagccccggggctggggcccgcgggcggggcgggaggggaggctgggggcggcgggcccctcctggccattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggc

SEQ ID NO: 122793 - DNA, 563 bp, Homo sapiens
  chr3:184321768-184322331
  Hyper
taggtggcttggaaacgttcagtagtcggacctgggccacggagggcacagcggccactctttctgagaggcagaggtcggtgggctccaccctcccactccgagccggcctgaccctcggtgcaggcggaaggggggccgcggggagcggaggacggtgccgaggcctcgctgctgctgcagcgcccccgccccgcgtcgcctcccagccctggctcccagtgctccgggcttgctgacggtacagggtggacagccccgagacattttcatcagatctcgtctcccgcagcccagcgctgctgccgggggtcggacagggccgatcccagcacccctcccccgagccctggctgggcgagaaaccgagatggtggctgcagaaaccggagcccccgcgccggggcgaccgcgaggggccgaggcctttgagagcgctgccgccccttgccaaggtcaatcaaaccctcccacgctccggaggcgcgcgctgcgtgctctaggcagcggggattggggccggaggggcgcgtcccggcggggccgggcgagggtgggtgggg

SEQ ID NO: 122794 - DNA, 150 bp, Homo sapiens; identical to SEQ ID NO: 90766
  chr3:184459092-184459242
  Hypo

SEQ ID NO: 122795 - DNA, 109 bp, Homo sapiens; identical to SEQ ID NO: 40092
  chr3:184785147-184785256
  Hypo

SEQ ID NO: 122796 - DNA, 112 bp, Homo sapiens; identical to SEQ ID NO: 90770
  chr3:184870195-184870307
  Hyper

SEQ ID NO: 122797 - DNA, 776 bp, Homo sapiens; identical to SEQ ID NO: 90771
  chr3:184870608-184871384
  Hyper

SEQ ID NO: 122798 - DNA, 88 bp, Homo sapiens; identical to SEQ ID NO: 90772
  chr3:185001579-185001667
  Hypo

SEQ ID NO: 122799 - DNA, 28 bp, Homo sapiens
  chr3:185001907-185001935
  Hypo
gaaccactacgcgcggccactttccttt

SEQ ID NO: 122800 - DNA, 23 bp, Homo sapiens
  chr3:185270882-185270905
  Hypo
aaaagaaaaacaggccggcacgg

SEQ ID NO: 122801 - DNA, 84 bp, Homo sapiens; identical to SEQ ID NO: 90775
  chr3:185271296-185271380
  Hypo

SEQ ID NO: 122802 - DNA, 80 bp, Homo sapiens; identical to SEQ ID NO: 90776
  chr3:185277764-185277844
  Hypo

SEQ ID NO: 122803 - DNA, 30 bp, Homo sapiens; identical to SEQ ID NO: 14609
  chr3:185278325-185278355
  Hypo

SEQ ID NO: 122804 - DNA, 40 bp, Homo sapiens; identical to SEQ ID NO: 90778
  chr3:185302868-185302908
  Hypo

SEQ ID NO: 122805 - DNA, 30 bp, Homo sapiens; identical to SEQ ID NO: 90779
  chr3:185303247-185303277
  Hypo

SEQ ID NO: 122806 - DNA, 30 bp, Homo sapiens; identical to SEQ ID NO: 90780
  chr3:185362704-185362734
  Hypo

SEQ ID NO: 122807 - DNA, 338 bp, Homo sapiens; identical to SEQ ID NO: 90781
  chr3:185362967-185363305
  Hypo

SEQ ID NO: 122808 - DNA, 34 bp, Homo sapiens; identical to SEQ ID NO: 90782
  chr3:185363531-185363565
  Hypo

SEQ ID NO: 122809 - DNA, 136 bp, Homo sapiens; identical to SEQ ID NO: 40098
  chr3:185385541-185385677
  Hypo

SEQ ID NO: 122810 - DNA, 37 bp, Homo sapiens; identical to SEQ ID NO: 90784
  chr3:185446057-185446094
  Hypo

SEQ ID NO: 122811 - DNA, 30 bp, Homo sapiens; identical to SEQ ID NO: 90785
  chr3:185457365-185457395
  Hypo

SEQ ID NO: 122812 - DNA, 17 bp, Homo sapiens
  chr3:185504539-185504556
  Hypo
tacgtggaaacctacat

SEQ ID NO: 122813 - DNA, 127 bp, Homo sapiens; identical to SEQ ID NO: 90787
  chr3:185543557-185543684
  Hyper

SEQ ID NO: 122814 - DNA, 172 bp, Homo sapiens; identical to SEQ ID NO: 90788
  chr3:185543923-185544095
  Hyper

SEQ ID NO: 122815 - DNA, 29 bp, Homo sapiens
  chr3:185547274-185547303
  Hypo
tcctgctgtgtagccgggttcctaacagg

SEQ ID NO: 122816 - DNA, 35 bp, Homo sapiens; identical to SEQ ID NO: 90790
  chr3:185551925-185551960
  Hypo

SEQ ID NO: 122817 - DNA, 30 bp, Homo sapiens; identical to SEQ ID NO: 90791
  chr3:185552326-185552356
  Hypo

SEQ ID NO: 122818 - DNA, 30 bp, Homo sapiens; identical to SEQ ID NO: 90792
  chr3:185598167-185598197
  Hypo

SEQ ID NO: 122819 - DNA, 81 bp, Homo sapiens; identical to SEQ ID NO: 90793
  chr3:185643324-185643405
  Hypo

SEQ ID NO: 122820 - DNA, 91 bp, Homo sapiens; identical to SEQ ID NO: 40102
  chr3:185667518-185667609
  Hypo

SEQ ID NO: 122821 - DNA, 30 bp, Homo sapiens; identical to SEQ ID NO: 90795
  chr3:186019122-186019152
  Hypo

SEQ ID NO: 122822 - DNA, 619 bp, Homo sapiens; identical to SEQ ID NO: 90796
  chr3:186078712-186079331
  Hyper

SEQ ID NO: 122823 - DNA, 674 bp, Homo sapiens
  chr3:186079621-186080295
  Hyper
agccccttccctggccgcgggaccggctcccgctttgccctcctttaccaagttgctgcaccgggtgctccctgagccggggaccccctccgccgcgccggccgccgtcttacctcaccaggcaacacttggttgcgcggtggcccggggcgctccttcttcgcggtttattcccttacttgggaggaaagaggaaccgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcacacacgaatgtggatccgctcgatgggaacctgaccccctttggtgcaactagggcgcgggcatcattaggacgctttttactgacagggcttcggtttgggaggagg

SEQ ID NO: 122824 - DNA, 22 bp, Homo sapiens
  chr3:186329022-186329044
  Hypo
ttcttttttttgagtcggagtc

SEQ ID NO: 122825 - DNA, 136 bp, Homo sapiens; identical to SEQ ID NO: 90801
  chr3:186495172-186495308
  Hypo

SEQ ID NO: 122826 - DNA, 78 bp, Homo sapiens; identical to SEQ ID NO: 40105
  chr3:186527185-186527263
  Hypo

SEQ ID NO: 122827 - DNA, 41 bp, Homo sapiens; identical to SEQ ID NO: 90803
  chr3:186648285-186648326
  Hyper

SEQ ID NO: 122828 - DNA, 30 bp, Homo sapiens; identical to SEQ ID NO: 90804
  chr3:186649839-186649869
  Hyper

SEQ ID NO: 122829 - DNA, 664 bp, Homo sapiens; identical to SEQ ID NO: 28626
  chr3:186857050-186857714
  Hyper

SEQ ID NO: 122830 - DNA, 43 bp, Homo sapiens
  chr3:187086277-187086320
  Hyper
caagaggcaaaaccccgggccacatggacgctgaagttggatg

SEQ ID NO: 122831 - DNA, 38 bp, Homo sapiens; identical to SEQ ID NO: 90807
  chr3:187238765-187238803
  Hypo

SEQ ID NO: 122832 - DNA, 35 bp, Homo sapiens; identical to SEQ ID NO: 90808
  chr3:187253705-187253740
  Hypo

SEQ ID NO: 122833 - DNA, 448 bp, Homo sapiens
  chr3:187387791-187388239
  Hyper
ttttctcaagagcttcgggagctgagggacccagaaaagcaccaaaactctttagaaggactgagcatcccttacgtccaaaccaatggggcaggagcaaggcttagggagggctggagaatccgggagacgtcgagggagtctccttacctgcttccccgcggcagcagccagggacttctgcagaaactgacggagtctggggtccgagggagcgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctctcaaccgtctccctctgttttaaactctctctctgacgtcaggctaggagg

SEQ ID NO: 122834 - DNA, 178 bp, Homo sapiens; identical to SEQ ID NO: 90812
  chr3:187416640-187416818
  Hypo

SEQ ID NO: 122835 - DNA, 1324 bp, Homo sapiens; identical to SEQ ID NO: 90813
  chr3:187455342-187456666
  Hyper

SEQ ID NO: 122836 - DNA, 542 bp, Homo sapiens; identical to SEQ ID NO: 28630
  chr3:187457112-187457654
  Hyper

SEQ ID NO: 122837 - DNA, 190 bp, Homo sapiens; identical to SEQ ID NO: 40107
  chr3:187870406-187870596
  Hypo

SEQ ID NO: 122838 - DNA, 36 bp, Homo sapiens; identical to SEQ ID NO: 90816
  chr3:188096606-188096642
  Hypo

SEQ ID NO: 122839 - DNA, 31 bp, Homo sapiens; identical to SEQ ID NO: 90817
  chr3:189114996-189115027
  Hypo

SEQ ID NO: 122840 - DNA, 17 bp, Homo sapiens
  chr3:189838424-189838441
  Hyper
ccggcgtgggctgtccg

SEQ ID NO: 122841 - DNA, 377 bp, Homo sapiens; identical to SEQ ID NO: 90819
  chr3:189838501-189838878
  Hyper

SEQ ID NO: 122842 - DNA, 99 bp, Homo sapiens; identical to SEQ ID NO: 90820
  chr3:190039853-190039952
  Hyper

SEQ ID NO: 122843 - DNA, 195 bp, Homo sapiens; identical to SEQ ID NO: 90821
  chr3:190040207-190040402
  Hyper

SEQ ID NO: 122844 - DNA, 29 bp, Homo sapiens
  chr3:190065742-190065771
  Hypo
agaccatgggctgggcgcggtggctcaca

SEQ ID NO: 122845 - DNA, 159 bp, Homo sapiens; identical to SEQ ID NO: 90823
  chr3:190529604-190529763
  Hyper

SEQ ID NO: 122846 - DNA, 554 bp, Homo sapiens; identical to SEQ ID NO: 90824
  chr3:190580406-190580960
  Hyper

SEQ ID NO: 122847 - DNA, 82 bp, Homo sapiens; identical to SEQ ID NO: 90825
  chr3:190595746-190595828
  Hypo

SEQ ID NO: 122848 - DNA, 74 bp, Homo sapiens; identical to SEQ ID NO: 90826
  chr3:191670699-191670773
  Hypo

SEQ ID NO: 122849 - DNA, 17 bp, Homo sapiens
  chr3:191929220-191929237
  Hypo
tttatttttttgagacg

SEQ ID NO: 122850 - DNA, 2326 bp, Homo sapiens
  chr3:192125814-192128140
  Hyper
tggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctcagctggagtgctagctccgcaggaaactcggggcccgggcgagagccaccgagatggcaggtgggacgcagagcccgcggcagccagagttcctcccgcacggcccgccgacccacggaagagcgaaagagcgcccaggtggggccgagctgggggccgggcccctggagcgctgggaagcacagcgcgctctagtcaggttccctttcctggagccctccgcttccagactcccttctttcctccctccctcccgccacccctctccctcctctctgtgtcttctgtctctccccttttctcctctctacgcaatcctacgtgattgaggtttg

SEQ ID NO: 122851 - DNA, 507 bp, Homo sapiens
  chr3:192231853-192232360
  Hyper
ttctttcttttcctccgtgtagtctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcacgagcaacttttcggagacactgaacaactccaagtcgcgcgccgccctcgcaaatcgcagagagggccgcgagaaggtgcgaacgcaggtcacggccagcgccgcttggagagagacccgcaggtttcagcccaggcgcgcccggcgaaagccaacgcgctctccctacaaagcgtcgatgacttcagggatttaaaagaaaaaatacccacagacagaaccagcggaggggccctgacctcgccccagtcgggaaacgccttccctccgccacaggcagcgc

SEQ ID NO: 122852 - DNA, 965 bp, Homo sapiens
  chr3:192232564-192233529
  Hyper
ggttggtcaactccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggaggcggtggctggtctgaggacgacgcggaggacgtcactgcgggtcggtgcttccttacaggtgccttctggaccggggtccttggcacctcccctgctcctgccctcggtgccggaccctgtgccctgggagcccgactacctcggtgtcccagccgtcccgggcttgaggcgctgagagggctgcgcggcttccagcccggaaggcagcggtcccgcgggctgcgcgcggccaagggcgactccggtgtgggaatccggcggaagggaagcacccgcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggc

SEQ ID NO: 122853 - DNA, 249 bp, Homo sapiens
  chr3:192445228-192445477
  Hyper
tgcatgcacagtgcccgctcagatttttttttttttttttttacctgggtctggaagctgcaggcaggagctgtcctccgagcgtggtgctgcaggtgtagtgacagatcatcccactttgctctctggatgcacagcagatttgcatgggcgctggcacgcatgcgcagggcgtcccccctccccttttcaccgcctcccgctcccccgcccccttcgcctccctccccaatacggtcctcagttatc

SEQ ID NO: 122854 - DNA, 802 bp, Homo sapiens; identical to SEQ ID NO: 90844
  chr3:192634345-192635147
  Hyper

SEQ ID NO: 122855 - DNA, 30 bp, Homo sapiens; identical to SEQ ID NO: 90845
  chr3:192754793-192754823
  Hypo

SEQ ID NO: 122856 - DNA, 198 bp, Homo sapiens; identical to SEQ ID NO: 90846
  chr3:192958910-192959108
  Hyper

SEQ ID NO: 122857 - DNA, 53 bp, Homo sapiens; identical to SEQ ID NO: 90847
  chr3:193093790-193093843
  Hypo

SEQ ID NO: 122858 - DNA, 36 bp, Homo sapiens; identical to SEQ ID NO: 90848
  chr3:193103643-193103679
  Hypo

SEQ ID NO: 122859 - DNA, 37 bp, Homo sapiens; identical to SEQ ID NO: 90849
  chr3:193312128-193312165
  Hypo

SEQ ID NO: 122860 - DNA, 32 bp, Homo sapiens; identical to SEQ ID NO: 90850
  chr3:193419609-193419641
  Hypo

SEQ ID NO: 122861 - DNA, 174 bp, Homo sapiens; identical to SEQ ID NO: 5009
  chr3:193548530-193548704
  Hypo

SEQ ID NO: 122862 - DNA, 30 bp, Homo sapiens; identical to SEQ ID NO: 90852
  chr3:193548916-193548946
  Hypo

SEQ ID NO: 122863 - DNA, 252 bp, Homo sapiens; identical to SEQ ID NO: 90853
  chr3:193588098-193588350
  Hypo

SEQ ID NO: 122864 - DNA, 114 bp, Homo sapiens; identical to SEQ ID NO: 90854
  chr3:193656666-193656780
  Hypo

SEQ ID NO: 122865 - DNA, 30 bp, Homo sapiens; identical to SEQ ID NO: 40114
  chr3:193774655-193774685
  Hypo

SEQ ID NO: 122866 - DNA, 385 bp, Homo sapiens
  chr3:193776076-193776461
  Hyper
cggttcctctgcagacgttcagccccttcggaaatgtaaaacccgggaagcgaaagctgcggcgacctcccagagcctctcaggcacgcggcatctctccccaccggcagcgccttgaaataccaaaggcctagccaaagatggaaccgttttgttgggagctcgggtttcccccgccgcgaggctgagccggtggcgcagctgctcaaaggtcacgcccgagacacgtccgcacaagcccgggtggcggggcgggcagcggggagagaagaggggagtggggagggggacgggggcaggggggaggggcgccaccttctccagggccctgcggggtgggctcccatcttcatctcgcaagcatccaacccggggaggtggcttt

SEQ ID NO: 122867 - DNA, 33 bp, Homo sapiens; identical to SEQ ID NO: 90858
  chr3:193858603-193858636
  Hyper

SEQ ID NO: 122868 - DNA, 36 bp, Homo sapiens; identical to SEQ ID NO: 14616
  chr3:193922775-193922811
  Hypo

SEQ ID NO: 122869 - DNA, 30 bp, Homo sapiens; identical to SEQ ID NO: 90860
  chr3:193943217-193943247
  Hypo

SEQ ID NO: 122870 - DNA, 30 bp, Homo sapiens; identical to SEQ ID NO: 90861
  chr3:193969848-193969878
  Hypo

SEQ ID NO: 122871 - DNA, 18 bp, Homo sapiens
  chr3:194041075-194041093
  Hypo
agcactttgggaggccga

SEQ ID NO: 122872 - DNA, 197 bp, Homo sapiens; identical to SEQ ID NO: 40117
  chr3:194048751-194048948
  Hypo

SEQ ID NO: 122873 - DNA, 30 bp, Homo sapiens; identical to SEQ ID NO: 40118
  chr3:194128418-194128448
  Hypo

SEQ ID NO: 122874 - DNA, 514 bp, Homo sapiens
  chr3:194208071-194208585
  Hyper
cagtgactagacagacgttgcccagagtcatggtcatggaggaagcttgtgctagaatggtggagaggaaaccagagcccagctcctaatgcaaggctctttcattcctttagccaccctcgcccccgccaaaacaaacagacaaaaaactgtcattctcatatgaccacggactctgcgccccggccgcaggcggaggacagggaggagcgcacacgagaaagctcccacgcgcccgcgcctcgcctccgacgggaaggcgcctcttccgaccgtcctggatgcaaattaaatacttccctccgcagaagacttatctcggggtagggccgcagccggatttccaaatcgcgggtttgattttcgctgcgtcctctccgcgacgcgcgcagggagcgcgcccggccacctgcagcctctggctgcggccatctttccgcctggggccacctggcctgcgccctttgtgcccggcccgctccgtgactgttcttcttgccgctacttacagaac

SEQ ID NO: 122875 - DNA, 30 bp, Homo sapiens; identical to SEQ ID NO: 90867
  chr3:194319447-194319477
  Hypo

SEQ ID NO: 122876 - DNA, 52 bp, Homo sapiens; identical to SEQ ID NO: 90868
  chr3:194374304-194374356
  Hypo

SEQ ID NO: 122877 - DNA, 401 bp, Homo sapiens; identical to SEQ ID NO: 90869
  chr3:194407435-194407836
  Hyper

SEQ ID NO: 122878 - DNA, 990 bp, Homo sapiens
  chr3:194408129-194409119
  Hyper
cggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggt

SEQ ID NO: 122879 - DNA, 36 bp, Homo sapiens; identical to SEQ ID NO: 90872
  chr3:194827205-194827241
  Hyper

SEQ ID NO: 122880 - DNA, 40 bp, Homo sapiens; identical to SEQ ID NO: 90873
  chr3:194834954-194834994
  Hypo

SEQ ID NO: 122881 - DNA, 43 bp, Homo sapiens; identical to SEQ ID NO: 90874
  chr3:195183871-195183914
  Hypo

SEQ ID NO: 122882 - DNA, 37 bp, Homo sapiens; identical to SEQ ID NO: 90875
  chr3:195274920-195274957
  Hypo

SEQ ID NO: 122883 - DNA, 172 bp, Homo sapiens; identical to SEQ ID NO: 90876
  chr3:195474886-195475058
  Hyper

SEQ ID NO: 122884 - DNA, 30 bp, Homo sapiens; identical to SEQ ID NO: 90877
  chr3:195495704-195495734
  Hypo

SEQ ID NO: 122885 - DNA, 75 bp, Homo sapiens; identical to SEQ ID NO: 90878
  chr3:195536670-195536745
  Hypo

SEQ ID NO: 122886 - DNA, 24 bp, Homo sapiens
  chr3:195538329-195538353
  Hypo
caccgcgcacggcctccactcttc

SEQ ID NO: 122887 - DNA, 293 bp, Homo sapiens; identical to SEQ ID NO: 90880
  chr3:195586977-195587270
  Hypo

SEQ ID NO: 122888 - DNA, 72 bp, Homo sapiens; identical to SEQ ID NO: 40123
  chr3:195597490-195597562
  Hypo

SEQ ID NO: 122889 - DNA, 154 bp, Homo sapiens; identical to SEQ ID NO: 90882
  chr3:195599686-195599840
  Hypo

SEQ ID NO: 122890 - DNA, 1277 bp, Homo sapiens; identical to SEQ ID NO: 90883
  chr3:195600086-195601363
  Hypo

SEQ ID NO: 122891 - DNA, 22 bp, Homo sapiens
  chr3:195602315-195602337
  Hypo
gcacgctcggaggcacaggaag

SEQ ID NO: 122892 - DNA, 76 bp, Homo sapiens; identical to SEQ ID NO: 90885
  chr3:195603847-195603923
  Hypo

SEQ ID NO: 122893 - DNA, 126 bp, Homo sapiens; identical to SEQ ID NO: 90886
  chr3:195604262-195604388
  Hypo

SEQ ID NO: 122894 - DNA, 30 bp, Homo sapiens; identical to SEQ ID NO: 40130
  chr3:195604945-195604975
  Hypo

SEQ ID NO: 122895 - DNA, 194 bp, Homo sapiens; identical to SEQ ID NO: 90888
  chr3:195637231-195637425
  Hypo

SEQ ID NO: 122896 - DNA, 30 bp, Homo sapiens; identical to SEQ ID NO: 90889
  chr3:195644193-195644223
  Hypo

SEQ ID NO: 122897 - DNA, 219 bp, Homo sapiens; identical to SEQ ID NO: 40132
  chr3:195648722-195648941
  Hypo

SEQ ID NO: 122898 - DNA, 30 bp, Homo sapiens; identical to SEQ ID NO: 90891
  chr3:195730384-195730414
  Hypo

SEQ ID NO: 122899 - DNA, 136 bp, Homo sapiens; identical to SEQ ID NO: 90892
  chr3:195834926-195835062
  Hypo

SEQ ID NO: 122900 - DNA, 76 bp, Homo sapiens; identical to SEQ ID NO: 90893
  chr3:195837125-195837201
  Hypo

SEQ ID NO: 122901 - DNA, 82 bp, Homo sapiens; identical to SEQ ID NO: 90894
  chr3:195874745-195874827
  Hypo

SEQ ID NO: 122902 - DNA, 167 bp, Homo sapiens; identical to SEQ ID NO: 90895
  chr3:195924532-195924699
  Hypo

SEQ ID NO: 122903 - DNA, 21 bp, Homo sapiens
  chr3:195926795-195926816
  Hypo
acagagcgacactctggctca

SEQ ID NO: 122904 - DNA, 41 bp, Homo sapiens; identical to SEQ ID NO: 90897
  chr3:195928204-195928245
  Hypo

SEQ ID NO: 122905 - DNA, 30 bp, Homo sapiens; identical to SEQ ID NO: 90898
  chr3:195945299-195945329
  Hypo

SEQ ID NO: 122906 - DNA, 36 bp, Homo sapiens; identical to SEQ ID NO: 40136
  chr3:195993024-195993060
  Hypo

SEQ ID NO: 122907 - DNA, 81 bp, Homo sapiens; identical to SEQ ID NO: 90900
  chr3:196056108-196056189
  Hypo

SEQ ID NO: 122908 - DNA, 36 bp, Homo sapiens; identical to SEQ ID NO: 90901
  chr3:196063642-196063678
  Hypo

SEQ ID NO: 122909 - DNA, 360 bp, Homo sapiens; identical to SEQ ID NO: 90902
  chr3:196069875-196070235
  Hypo

SEQ ID NO: 122910 - DNA, 30 bp, Homo sapiens; identical to SEQ ID NO: 90903
  chr3:196099492-196099522
  Hypo

SEQ ID NO: 122911 - DNA, 140 bp, Homo sapiens; identical to SEQ ID NO: 90904
  chr3:196226294-196226434
  Hypo

SEQ ID NO: 122912 - DNA, 30 bp, Homo sapiens; identical to SEQ ID NO: 90905
  chr3:196251394-196251424
  Hypo

SEQ ID NO: 122913 - DNA, 278 bp, Homo sapiens
  chr3:196255622-196255900
  Hyper
gcggtgtcgcgcctccgggccccatccggctcccagcatcttctcccgctgcggaggccgcatttccactcagggcagcgccgccgcggtggttccgccctgtcgggctcagaccggcctgggcgcctccgcggggagctgggcggtggcgggggccgcgggagtggagccggcccgagcctccagggggcgctggcggccgcttcctccatccgcaggcggctcccggccacgcccgtcgctgagcgtgaggcgatggcggccgagctcagaacact

SEQ ID NO: 122914 - DNA, 91 bp, Homo sapiens; identical to SEQ ID NO: 90907
  chr3:196256207-196256298
  Hypo

SEQ ID NO: 122915 - DNA, 30 bp, Homo sapiens; identical to SEQ ID NO: 14628
  chr3:196294577-196294607
  Hypo

SEQ ID NO: 122916 - DNA, 39 bp, Homo sapiens; identical to SEQ ID NO: 90909
  chr3:196318724-196318763
  Hypo

SEQ ID NO: 122917 - DNA, 482 bp, Homo sapiens; identical to SEQ ID NO: 90910
  chr3:196366435-196366917
  Hyper

SEQ ID NO: 122918 - DNA, 875 bp, Homo sapiens; identical to SEQ ID NO: 90911
  chr3:196386790-196387665
  Hypo

SEQ ID NO: 122919 - DNA, 440 bp, Homo sapiens; identical to SEQ ID NO: 90912
  chr3:196388333-196388773
  Hypo

SEQ ID NO: 122920 - DNA, 140 bp, Homo sapiens; identical to SEQ ID NO: 90913
  chr3:196389082-196389222
  Hypo

SEQ ID NO: 122921 - DNA, 30 bp, Homo sapiens; identical to SEQ ID NO: 90914
  chr3:196401622-196401652
  Hypo

SEQ ID NO: 122922 - DNA, 41 bp, Homo sapiens; identical to SEQ ID NO: 40146
  chr3:196402166-196402207
  Hypo

SEQ ID NO: 122923 - DNA, 40 bp, Homo sapiens; identical to SEQ ID NO: 90916
  chr3:196403527-196403567
  Hypo

SEQ ID NO: 122924 - DNA, 30 bp, Homo sapiens; identical to SEQ ID NO: 90917
  chr3:196406244-196406274
  Hypo

SEQ ID NO: 122925 - DNA, 26 bp, Homo sapiens
  chr3:196697284-196697310
  Hypo
accacaggccccgccaccatgcccgg

SEQ ID NO: 122926 - DNA, 75 bp, Homo sapiens; identical to SEQ ID NO: 90919
  chr3:196730975-196731050
  Hypo

SEQ ID NO: 122927 - DNA, 246 bp, Homo sapiens; identical to SEQ ID NO: 40148
  chr3:196731283-196731529
  Hypo

SEQ ID NO: 122928 - DNA, 242 bp, Homo sapiens; identical to SEQ ID NO: 90921
  chr3:196754516-196754758
  Hypo

SEQ ID NO: 122929 - DNA, 65 bp, Homo sapiens; identical to SEQ ID NO: 90922
  chr3:196755979-196756044
  Hyper

SEQ ID NO: 122930 - DNA, 76 bp, Homo sapiens; identical to SEQ ID NO: 90923
  chr3:196766119-196766195
  Hypo

SEQ ID NO: 122931 - DNA, 30 bp, Homo sapiens; identical to SEQ ID NO: 40150
  chr3:196784239-196784269
  Hypo

SEQ ID NO: 122932 - DNA, 17 bp, Homo sapiens
  chr3:196948094-196948111
  Hypo
aaacataacagggaccg

SEQ ID NO: 122933 - DNA, 173 bp, Homo sapiens; identical to SEQ ID NO: 90926
  chr3:197183173-197183346
  Hyper

SEQ ID NO: 122934 - DNA, 30 bp, Homo sapiens; identical to SEQ ID NO: 90927
  chr3:197183698-197183728
  Hyper

SEQ ID NO: 122935 - DNA, 161 bp, Homo sapiens; identical to SEQ ID NO: 90928
  chr3:197186095-197186256
  Hypo

SEQ ID NO: 122936 - DNA, 34 bp, Homo sapiens; identical to SEQ ID NO: 90929
  chr3:197226091-197226125
  Hypo

SEQ ID NO: 122937 - DNA, 30 bp, Homo sapiens; identical to SEQ ID NO: 90930
  chr3:197229517-197229547
  Hypo

SEQ ID NO: 122938 - DNA, 117 bp, Homo sapiens; identical to SEQ ID NO: 90931
  chr3:197246683-197246800
  Hypo

SEQ ID NO: 122939 - DNA, 25 bp, Homo sapiens
  chr3:197313900-197313925
  Hypo
tataagaacccaacacggcgaaacc

SEQ ID NO: 122940 - DNA, 300 bp, Homo sapiens; identical to SEQ ID NO: 40152
  chr3:197327024-197327324
  Hypo

SEQ ID NO: 122941 - DNA, 83 bp, Homo sapiens; identical to SEQ ID NO: 90934
  chr3:197327773-197327856
  Hypo

SEQ ID NO: 122942 - DNA, 162 bp, Homo sapiens; identical to SEQ ID NO: 90935
  chr3:197402041-197402203
  Hypo

SEQ ID NO: 122943 - DNA, 30 bp, Homo sapiens; identical to SEQ ID NO: 90936
  chr3:197479155-197479185
  Hypo

SEQ ID NO: 122944 - DNA, 21 bp, Homo sapiens
  chr3:197601763-197601784
  Hypo
agctcctggcagactcgagtg

SEQ ID NO: 122945 - DNA, 231 bp, Homo sapiens; identical to SEQ ID NO: 90938
  chr3:197608050-197608281
  Hypo

SEQ ID NO: 122946 - DNA, 30 bp, Homo sapiens; identical to SEQ ID NO: 90939
  chr3:197616707-197616737
  Hypo

SEQ ID NO: 122947 - DNA, 29 bp, Homo sapiens
  chr3:197677029-197677058
  Hyper
atcccacaaggccacgcggcggggcctcg

SEQ ID NO: 122948 - DNA, 87 bp, Homo sapiens; identical to SEQ ID NO: 90940
  chr3:197685732-197685819
  Hypo

SEQ ID NO: 122949 - DNA, 26 bp, Homo sapiens
  chr3:197686059-197686085
  Hypo
gagtgaaactccgtctcaaaaaaaaa

SEQ ID NO: 122950 - DNA, 246 bp, Homo sapiens
  chr3:197686977-197687223
  Hyper
cttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgtt

SEQ ID NO: 122951 - DNA, 317 bp, Homo sapiens; identical to SEQ ID NO: 90942
  chr3:197807228-197807545
  Hyper

SEQ ID NO: 122952 - DNA, 268 bp, Homo sapiens
  chr3:197840370-197840638
  Hyper
agaggaaaagacagacggcggcggggacattggagaggagaaaagagagggaggaagagaggcgggaaagacagaagaaaggcaggggaggcgcgacggggcgagggacggggaggaaagcggtctcccgcctccagggcgggccgagggctgggcccgcggggcgctcacgtccctccggatcgcccgcctgggtccgctcgccgcggagagagtctcagcagttccgactcccgaggaacgggcgacttcccgaaacacccaaggg

SEQ ID NO: 122953 - DNA, 511 bp, Homo sapiens
  chr4:107304-107815
  Hyper
gcgttcccagggccccggcgccccggccgggaagagccgcccaggaatcaggcagccgccgggcctcgacctgcgacgaggagccgacccgccgtgtcccgtgagtcgccccgggccctccgcccgcccctccgcgctgggcagggccccagcagttgtcctcctcccgctcccgggctcggcccgggctccatggggctccaggcgggcggcagcggccagcggtcccctgaagggccgagtcctcccttccctcctcctgctcctcccccgcgcggtcgccgagggcgagaccgacttttgccgcaaggtgcaggcggcccgggcggcggcggctcgggaaacgcatggccctggggacgcggcgaggacaggagagcccggctgcgaggtcgggaccctgaggcccaggggcgggtccgcggcgtgcggggccctggcggctcctctgtgctgcgctgggctccgggcgcgcgggatgcgggcagcggcgggacggtccacacgggcg

SEQ ID NO: 122954 - DNA, 1030 bp, Homo sapiens
  chr4:330301-331331
  Hyper
tgcccgcgcccggagcggatgggcctggcccggctccaccccgcggggctccgcggctcaacgggtcgcccaggggcgcgggcccggcttcgtcctcgacggtgtccgccccggccctggctaggccgacggcagccgggtccgggtggggctcgggctcggggcgcgcccctcccatctctccagggtccgcgtcctcgctgccgccaggtcccgccgagatccccggtggccccggctccagcggctgcagcgtcgccatcgccgggcagaccccggccgacctcaaagcgaccgcgcggtggggccggcggggactggggctgcgcagcgcggcctggggtgggggcggcggggcccccaggagctcctgggaaccgagggtcctggggcggtcccgccccgcacagctccgggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgtataatttcta

SEQ ID NO: 122955 - DNA, 736 bp, Homo sapiens; identical to SEQ ID NO: 92100
  chr4:331562-332298
  Hyper

SEQ ID NO: 122956 - DNA, 53 bp, Homo sapiens; identical to SEQ ID NO: 92142
  chr4:379992-380045
  Hyper

SEQ ID NO: 122957 - DNA, 207 bp, Homo sapiens; identical to SEQ ID NO: 92143
  chr4:380356-380563
  Hyper

SEQ ID NO: 122958 - DNA, 30 bp, Homo sapiens; identical to SEQ ID NO: 92298
  chr4:552737-552767
  Hypo

SEQ ID NO: 122959 - DNA, 2206 bp, Homo sapiens
  chr4:568295-570501
  Hyper
gtcgccgtcctggggcgctcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaacgcaagcgcggtccgcgggatgggggtccggcccgcgggatcagcaggcccgatgggtctcccagggccgcggcgtctcgcagggcggccggcagcagtaggggtaggaggcgttgaggtcggggtccgagggcgcgtaccccggcagctccaccgacgggtgccccccgcagcgcacctccgcgcccgcctcgtccagcgcgtggaggacgcctacgttgatgtaggagaccgcgtggtgcgccgcgaagcccgcgcagtccccgggggcggccaggtccgactcctccggggacaggatggaggcctcgctcggccgctgctgcagccgccgcccccgccggccccgccggccccggcgcgcccgagaggcgggcggctgcgcgcggagcccggagccgccgcggggccgcgccagggcccggcctcccctccgcctgccgcgccgaccgcgccgggcctgcgacgacttgtagttcttgacgagcaggaggctgagcaggcccagcaggcactcaagcgagttgaagacggtggagagcaccaggccgcgctggtagtccttcagctggcggcacttggcggacgtggcgctgtccagggtgctgcgagcgcgcggggcgccgggggccgagcccggcgccgagccgggggccgagcccggggccgagccgggggttgagcccggggccgagccggggctcgaacctggcgcccgcgggggcaggcagtagtgcgagtacttgcgctccaccagggacacggtgtcgccgtcgatcacggcgcccgcgaatgcgctgaggaccccgagcatgaagaccaggacgccgagcagaagcaggttctggctgctcaccggccccggggccccggccgcggcccccgactcgcccggcgtggcctcgggagcgcctgccggcgccgcggggacccccaaacccgggcccggttccgaccccgcgaggggcgcgtcccggggtccgcagcagagcagggcggcgccgagcagtgagaggccggcggccagcagcagcccggagtagaaggcgccggcggcggcccccaggcggaacggctccccgcgcagctccgagcccaacgagaagcacttgaggccgacggcggcggcgctgagcgcgcaggcgagcaggaggcaggaggagagcgcggcgcaggccccgcggacgctccacttcatcctccgcgcccgagccggcccgcaccccgcgcgcccgccgccgcccgccgccgcccccgccgcctgcgcctcctcccggcgccgcgcggccggaccgccggcctcctcctcatcctcccgcgtcctcccgggcccgcgccgccgccgccggagcccgcatcctccgcctcccgccgccgccgccgccgccgccgccgccgcgaccccgcgccgggaaccgatgcggcgcagagaccgcagggcgcgcgccccctccccagcccgcggggcccctcccaggaggctcgttcccccccaaccccccaccccgcccgcggccccgcgcgcctcgccctggcgccgcccttccccgcccccggcagcccccgccacccccgggacgcccctccgcttcctcctcccggagcgggggcccctggccgcgtctctccgccttccctccctatccgcgcccctatccggcgcgggccgctgcggaaacgcagctctccacccccagctggctctcccggaccccctgggccccaccctcagcgctccccaccgctcggcgcccctgcgtctgcgctcccctctctcccctctctatccactgggtctgggccgcacttcccgcccacccgcctgccagcggccgggaagcctgtgga

SEQ ID NO: 122960 - DNA, 1356 bp, Homo sapiens; identical to SEQ ID NO: 92325
  chr4:570836-572192
  Hyper

SEQ ID NO: 122961 - DNA, 36 bp, Homo sapiens; identical to SEQ ID NO: 92362
  chr4:617245-617281
  Hypo

SEQ ID NO: 122962 - DNA, 372 bp, Homo sapiens; identical to SEQ ID NO: 92364
  chr4:619507-619879
  Hypo

SEQ ID NO: 122963 - DNA, 638 bp, Homo sapiens; identical to SEQ ID NO: 92377
  chr4:628132-628770
  Hypo

SEQ ID NO: 122964 - DNA, 120 bp, Homo sapiens; identical to SEQ ID NO: 92378
  chr4:628830-628950
  Hypo

SEQ ID NO: 122965 - DNA, 37 bp, Homo sapiens; identical to SEQ ID NO: 92379
  chr4:629370-629407
  Hypo

SEQ ID NO: 122966 - DNA, 33 bp, Homo sapiens; identical to SEQ ID NO: 92384
  chr4:650380-650413
  Hypo

SEQ ID NO: 122967 - DNA, 510 bp, Homo sapiens; identical to SEQ ID NO: 92385
  chr4:650838-651348
  Hypo

SEQ ID NO: 122968 - DNA, 30 bp, Homo sapiens; identical to SEQ ID NO: 92387
  chr4:652650-652680
  Hypo

SEQ ID NO: 122969 - DNA, 46 bp, Homo sapiens; identical to SEQ ID NO: 92391
  chr4:657666-657712
  Hyper

SEQ ID NO: 122970 - DNA, 46 bp, Homo sapiens; identical to SEQ ID NO: 92392
  chr4:658106-658152
  Hyper

SEQ ID NO: 122971 - DNA, 359 bp, Homo sapiens; identical to SEQ ID NO: 92393
  chr4:660870-661229
  Hypo

SEQ ID NO: 122972 - DNA, 294 bp, Homo sapiens; identical to SEQ ID NO: 92401
  chr4:671984-672278
  Hypo

SEQ ID NO: 122973 - DNA, 33 bp, Homo sapiens; identical to SEQ ID NO: 92404
  chr4:676071-676104
  Hypo

SEQ ID NO: 122974 - DNA, 78 bp, Homo sapiens; identical to SEQ ID NO: 40163
  chr4:676743-676821
  Hypo

SEQ ID NO: 122975 - DNA, 185 bp, Homo sapiens; identical to SEQ ID NO: 92407
  chr4:678471-678656
  Hypo

SEQ ID NO: 122976 - DNA, 49 bp, Homo sapiens; identical to SEQ ID NO: 92408
  chr4:679019-679068
  Hypo

SEQ ID NO: 122977 - DNA, 175 bp, Homo sapiens
  chr4:682771-682946
  Hyper
ctgcccctaccgtggcgttggagcagttgagcaggctgatcgcgagcaggaacacccagcggcgcgcgtaggtgcggtggccccgctgcgcgcacagggcccggggctcggccaaccccgtctcggcctccgtcggccccgccatcgtcggcggcctccacgggtctccgccggt

SEQ ID NO: 122978 - DNA, 34 bp, Homo sapiens; identical to SEQ ID NO: 92410
  chr4:692476-692510
  Hypo

SEQ ID NO: 122979 - DNA, 79 bp, Homo sapiens; identical to SEQ ID NO: 92419
  chr4:718161-718240
  Hypo

SEQ ID NO: 122980 - DNA, 196 bp, Homo sapiens; identical to SEQ ID NO: 92433
  chr4:738289-738485
  Hypo

SEQ ID NO: 122981 - DNA, 57 bp, Homo sapiens; identical to SEQ ID NO: 92434
  chr4:741730-741787
  Hypo

SEQ ID NO: 122982 - DNA, 30 bp, Homo sapiens; identical to SEQ ID NO: 92448
  chr4:757296-757326
  Hypo

SEQ ID NO: 122983 - DNA, 104 bp, Homo sapiens; identical to SEQ ID NO: 92452
  chr4:759737-759841
  Hypo

SEQ ID NO: 122984 - DNA, 16 bp, Homo sapiens
  chr4:774267-774283
  Hypo
gcgcccagcctgtgtt

SEQ ID NO: 122985 - DNA, 126 bp, Homo sapiens; identical to SEQ ID NO: 92476
  chr4:779768-779894
  Hyper

SEQ ID NO: 122986 - DNA, 146 bp, Homo sapiens; identical to SEQ ID NO: 92477
  chr4:780132-780278
  Hyper

SEQ ID NO: 122987 - DNA, 156 bp, Homo sapiens; identical to SEQ ID NO: 92479
  chr4:786342-786498
  Hyper

SEQ ID NO: 122988 - DNA, 818 bp, Homo sapiens; identical to SEQ ID NO: 92480
  chr4:788774-789592
  Hyper

SEQ ID NO: 122989 - DNA, 118 bp, Homo sapiens; identical to SEQ ID NO: 92505
  chr4:819123-819241
  Hyper

SEQ ID NO: 122990 - DNA, 161 bp, Homo sapiens; identical to SEQ ID NO: 40169
  chr4:828951-829112
  Hypo

SEQ ID NO: 122991 - DNA, 487 bp, Homo sapiens; identical to SEQ ID NO: 92521
  chr4:829521-830008
  Hypo

SEQ ID NO: 122992 - DNA, 30 bp, Homo sapiens; identical to SEQ ID NO: 92581
  chr4:870008-870038
  Hypo

SEQ ID NO: 122993 - DNA, 62 bp, Homo sapiens; identical to SEQ ID NO: 92635
  chr4:905870-905932
  Hypo

SEQ ID NO: 122994 - DNA, 360 bp, Homo sapiens; identical to SEQ ID NO: 92658
  chr4:955184-955544
  Hypo

SEQ ID NO: 122995 - DNA, 1199 bp, Homo sapiens; identical to SEQ ID NO: 92659
  chr4:955851-957050
  Hypo

SEQ ID NO: 122996 - DNA, 30 bp, Homo sapiens; identical to SEQ ID NO: 92663
  chr4:957409-957439
  Hypo

SEQ ID NO: 122997 - DNA, 186 bp, Homo sapiens
  chr4:967581-967767
  Hyper
tgggctcggtttgaccgcagccgggccagacttctccggacgccgcacgcgcggcgttgtacctgcggggtcccggcccgcggctgcgcagacaggcgcctcccacgcgagacgcggatgctgtccgaggcccccggccgcgcaggacgcccccggcgaggggcagcgctgcgggcctcccacagt

SEQ ID NO: 122998 - DNA, 30 bp, Homo sapiens; identical to SEQ ID NO: 92679
  chr4:980454-980484
  Hyper

SEQ ID NO: 122999 - DNA, 117 bp, Homo sapiens; identical to SEQ ID NO: 92681
  chr4:994673-994790
  Hypo

SEQ ID NO: 123000 - DNA, 1384 bp, Homo sapiens
  chr4:995855-997239
  Hyper
ccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctgggtgagccggggccgctggggtgggccggccagggccctccaggctggggagcggctcctgcgaaggccccgctgcggggagcgcacttcctccagccgcgcgcttcccggggtcggcctccgcgtggcggggcctggggactccttcaccaaggggagggggagcgagtggtgggaggcccggccctgggtcggggggcggctgggcaacgaccccacgcggcgacggcccccccccgccccgcagatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggtaagccggggttccagggaggtctctggccccgctggggctctggagggggcggcccggggagccgaggcctgagtgtcaggccccgcaggcctggtctacgtcacgcgctacctggacaacgggctctgcagccccgacggcgagtggcggcgcctgggccggcccgtcttccccacggcagagcagttccggcgcatgcgcgcggctgaggtaggtgggccgcggaggggcgaggggccgggccgggccggggtcccgggggggtggggtccggggcgggggctccgaggcggtgtgggtgggaggtggagcggtgggccgggggcgttcgccctgaggtcgggccgagcgtccccagctcccctggagaaccctgaggaccggccactgcgcccaggacccggtggccgcggcgccccgccccttacccgccggcggccgcctgaccctgcgccccgcgctgcggctgccgtcgcttttgctggtgcacgtgtgtgcgcgccc

SEQ ID NO: 123001 - DNA, 147 bp, Homo sapiens; identical to SEQ ID NO: 91403
  chr4:1008582-1008729
  Hypo

SEQ ID NO: 123002 - DNA, 359 bp, Homo sapiens
  chr4:1016007-1016366
  Hypo
gacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggtgtgcaggagggcggacggggacacacctggggcccgagagtcagccagc

SEQ ID NO: 123003 - DNA, 499 bp, Homo sapiens; identical to SEQ ID NO: 91407
  chr4:1016612-1017111
  Hypo

SEQ ID NO: 123004 - DNA, 30 bp, Homo sapiens; identical to SEQ ID NO: 91409
  chr4:1020713-1020743
  Hypo

SEQ ID NO: 123005 - DNA, 30 bp, Homo sapiens; identical to SEQ ID NO: 40177
  chr4:1022834-1022864
  Hypo

SEQ ID NO: 123006 - DNA, 333 bp, Homo sapiens; identical to SEQ ID NO: 91411
  chr4:1024175-1024508
  Hypo

SEQ ID NO: 123007 - DNA, 471 bp, Homo sapiens; identical to SEQ ID NO: 91412
  chr4:1025819-1026290
  Hypo

SEQ ID NO: 123008 - DNA, 327 bp, Homo sapiens; identical to SEQ ID NO: 91416
  chr4:1036212-1036539
  Hypo

SEQ ID NO: 123009 - DNA, 66 bp, Homo sapiens; identical to SEQ ID NO: 91418
  chr4:1036897-1036963
  Hypo

SEQ ID NO: 123010 - DNA, 30 bp, Homo sapiens; identical to SEQ ID NO: 91434
  chr4:1076633-1076663
  Hypo

SEQ ID NO: 123011 - DNA, 75 bp, Homo sapiens; identical to SEQ ID NO: 91454
  chr4:1093400-1093475
  Hypo

SEQ ID NO: 123012 - DNA, 336 bp, Homo sapiens
  chr4:1165347-1165683
  Hyper
caggaaatccctccccgccgcccgcagggaaccatggcccccagtcacgtcggaccgtgacaccctgtggctgcccctgccgcgacccacctgcgccctccccgtgagcgccccctgcccccaccgcatccccggaaccgcacaccgcaggcgctcggcaaacattctggtgttagagtctcccgacgtcagcacgccccagactgggaagcgccgccgtgcagctgtgcggggggctccggcgccgcagccctcctggtggagcaggaggcgaggagggggctgtacttacccagcagcgaagaccactgcgcaggggggcggaacagggggtac

SEQ ID NO: 123013 - DNA, 369 bp, Homo sapiens; identical to SEQ ID NO: 91528
  chr4:1165990-1166359
  Hyper

SEQ ID NO: 123014 - DNA, 79 bp, Homo sapiens; identical to SEQ ID NO: 91534
  chr4:1189021-1189100
  Hypo

SEQ ID NO: 123015 - DNA, 30 bp, Homo sapiens; identical to SEQ ID NO: 91542
  chr4:1200560-1200590
  Hypo

SEQ ID NO: 123016 - DNA, 30 bp, Homo sapiens; identical to SEQ ID NO: 91543
  chr4:1200921-1200951
  Hypo

SEQ ID NO: 123017 - DNA, 30 bp, Homo sapiens; identical to SEQ ID NO: 91567
  chr4:1256143-1256173
  Hypo

SEQ ID NO: 123018 - DNA, 72 bp, Homo sapiens; identical to SEQ ID NO: 91577
  chr4:1282473-1282545
  Hypo

SEQ ID NO: 123019 - DNA, 30 bp, Homo sapiens; identical to SEQ ID NO: 91584
  chr4:1290639-1290669
  Hypo

SEQ ID NO: 123020 - DNA, 579 bp, Homo sapiens; identical to SEQ ID NO: 91587
  chr4:1299056-1299635
  Hypo

SEQ ID NO: 123021 - DNA, 107 bp, Homo sapiens; identical to SEQ ID NO: 91591
  chr4:1331010-1331117
  Hypo

SEQ ID NO: 123022 - DNA, 163 bp, Homo sapiens; identical to SEQ ID NO: 91592
  chr4:1331733-1331896
  Hypo

SEQ ID NO: 123023 - DNA, 392 bp, Homo sapiens; identical to SEQ ID NO: 91593
  chr4:1332268-1332660
  Hypo

SEQ ID NO: 123024 - DNA, 305 bp, Homo sapiens; identical to SEQ ID NO: 91594
  chr4:1332878-1333183
  Hypo

SEQ ID NO: 123025 - DNA, 322 bp, Homo sapiens; identical to SEQ ID NO: 91595
  chr4:1338490-1338812
  Hypo

SEQ ID NO: 123026 - DNA, 43 bp, Homo sapiens; identical to SEQ ID NO: 91596
  chr4:1339099-1339142
  Hypo

SEQ ID NO: 123027 - DNA, 429 bp, Homo sapiens
  chr4:1396406-1396835
  Hyper
ctcaaggccaacacccgaggagccttggtccccaccggagaggattcacgggtgggcccggccgggcggagggcggcgcgggagcctgggagaagggggcgcggccgcctgcggtttattgattgagtgaagttccgcaaagtgcttcgcagcgggccgagcccgcgggagccacctgcccggccccgacgcgcatggtcatttataaatttaaaactcttccgtagcaaccggttatgtacagagtcaacgactggaatcgtagaaaacagccgggcccggcagcggcctcggaggcggagcggcacggggctcagaggtgcggcgcgtagaaggcgggcgccccgtaggtctgcgagcccagcacgaagggcgagagcaccgccgggctcgacaggaacggcagctgcgcggcgcacaccaggcctc

SEQ ID NO: 123028 - DNA, 626 bp, Homo sapiens
  chr4:1397154-1397780
  Hyper
ggtgaaggcggtgcgcgctcgccgcggcttcccggacttggagtcggaccccgtgcgcttccgcttgggcttcgccgccgtcgccgtgccctgcggggtggtccccgcgccccccggcgccgctgcacctcccggtgggccctgggcaacgggcgagttctcgcggggtccgggggccgctgcctcgtcgacggtggctccgggggacgcgtcggtctcagccgcgccctggcaacccgacccgcgggccccgaggccgccgccgcctccccgcgcctcctccgcgcctcgcgccgcctccgtctcgggcgcttcgtcctcgtcgtcgtcctcgtcgtcgggaacctcgtccccgctgtccgcgctcgggctgtggccgccgccgccgctgctgtagccgttggtgtcgttggtctcggcctcccctgccttgaaggggtcgccggcgtctgcgggagggagggacaaggacagggcagggcagttaggaccggccggttcccagatcccgccctccgcgcgccccgcttcctcccccagggttccctcccgccccctgctcagcgcctcctgcttcgtcacccgcctcctctctctctccttcgctctgtcgtttccctcccctc

SEQ ID NO: 123029 - DNA, 101 bp, Homo sapiens; identical to SEQ ID NO: 91634
  chr4:1398277-1398378
  Hyper

SEQ ID NO: 123030 - DNA, 50 bp, Homo sapiens
  chr4:1398676-1398726
  Hyper
agcaggagtaggatccgcccctagacgaccgcgagcgccgtcccagccct

SEQ ID NO: 123031 - DNA, 189 bp, Homo sapiens; identical to SEQ ID NO: 91636
  chr4:1399065-1399254
  Hyper

SEQ ID NO: 123032 - DNA, 64 bp, Homo sapiens; identical to SEQ ID NO: 91637
  chr4:1399500-1399564
  Hyper

SEQ ID NO: 123033 - DNA, 40 bp, Homo sapiens
  chr4:1399990-1400030
  Hyper
ggtggggcgcaggggcgctgcgggccgggccgctccagcc

SEQ ID NO: 123034 - DNA, 1620 bp, Homo sapiens
  chr4:1400248-1401868
  Hyper
cggcggctcgggccccgccacctactgggctcccatccctggcggcccccgcacctccacacgaccccgcgcaggcggccgctgctccgctcgctctcggcgccgcgccctgcgcttggccggtgctgccttcgccgccgccttaggcgcccgcggcgcccggtccgcgcatttatggcagccccgccggaggcgcccacgcgcccacacgccgaacacacgtgcgcccgcaggcggccgcggggctccgccgccctcgttagcgcgcgcgcctaattggctgcgaacggtcccgggccgaggaggcggaccccgcacaggacacacggacggagccgccgggcgggacgaacagacacgcagcccggagcccagagcggtccgcaggcggctgtggtggtcagcggcgcgtcgctgcgcctccgctcgtccggaaacggcgcgccagcctccttggctaagggggaggagacagccccggcttttaaataattgcgggatcaatctgcggcggggccgcagcgaccccagggcgcgcgggccagcgagcgccaagagttggctgggacatcccggcgcaggatgcggtgactggcctggcctctcctccgggcccccagcgcgcagggccctgagctccgaaggctcccacagctctggcgcccctcggcagttggggtggggatggggggagaggttctcacgcgcgattctccgagtctccgccgggtctgcagccccctcccgcgcgttccgtgggtctcggtcccgcctctctcacttgctcccgcttggggtctccttttgcgtctccagggtctctcttgctcagggtctgtgcccctccatcccttcccacgcccgcccctttcacgtcgtcaaattagggcccgacctggagtgccagcagaggggcggagccggcggtccccgggccgctcattagaagtggaatcgaaaatgagagactgcttgtccctcttaacccgcccccaaaagggggaccgacaaattgcacacacagcaggcggcctacataaaatcgatcctcttcaagtaaggagaaaatgtgtgtttcttccaaaaagaatacgacaaatgcccccttctccacatctggataaataggaagccccgcggcctgagtctttatttgggtacgttttatctacagcggcggtgtttgcaggacagggccctgcggcccgcggccctcggccctcgaggattgggcctggcgtccggagtcccagtgcgggatcgtggtagctccccggcgggtcgctcctctccctcctcctcctgcccacgcagcgagcagccagacgcaggtggaccctggtgggcgccggcagtgcgagcgcgcgcgcttcttcagggtgtgagcgcgcgggcgcgtgcaccggcgggtgtgcgcgccgccttacactgcggtccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagccccagggagcctggaactggttgggcggggcggggggggggcgca

SEQ ID NO: 123035 - DNA, 216 bp, Homo sapiens; identical to SEQ ID NO: 91646
  chr4:1402196-1402412
  Hyper

SEQ ID NO: 123036 - DNA, 642 bp, Homo sapiens
  chr4:1403963-1404605
  Hyper
gtatagtgtttgcctcgtgcgaagtgcactccaccccacacttggccccacagcctcgctgtgcacctccttgcatcggccggacgggggcggggggtgcgggcggaggacggggaaggaggctcctgtgtcccctcttctcgcccctgcacacactcgcgccacggcgacccatgttgatcaccggagtttgggaagtcagaggggagccctctgctttcaggcctgggttccttctctaagatatgcccacttaggggcctgtgactcctccagaatgagtgtaccacactcgggacaccagaagcgagaggggacacaggctctgacctcgagagcacgtcagctctggagacccgcggccccagcctcgtgtgcctccgcacagggcagcttcagcactgcgaacagcgccagcaccgcggacagcgcgctcccacctcgcccccggaggccacgggctcgggccgtgttcagcaccgcggacagcgccagcaactccgagggtctcctggcctccagcccgccgtctctgacctccctgccccgccctcgactccttctcaaactttgggatgccccaggggaggaagagggcggcaggctgtgtgtggagtcttggcacggcgtacattacacagc

SEQ ID NO: 123037 - DNA, 191 bp, Homo sapiens; identical to SEQ ID NO: 91654
  chr4:1407940-1408131
  Hyper

SEQ ID NO: 123038 - DNA, 38 bp, Homo sapiens; identical to SEQ ID NO: 91655
  chr4:1408475-1408513
  Hyper

SEQ ID NO: 123039 - DNA, 211 bp, Homo sapiens; identical to SEQ ID NO: 40189
  chr4:1504889-1505100
  Hypo

SEQ ID NO: 123040 - DNA, 157 bp, Homo sapiens; identical to SEQ ID NO: 91713
  chr4:1512241-1512398
  Hypo

SEQ ID NO: 123041 - DNA, 224 bp, Homo sapiens; identical to SEQ ID NO: 91714
  chr4:1514843-1515067
  Hyper

SEQ ID NO: 123042 - DNA, 78 bp, Homo sapiens; identical to SEQ ID NO: 91725
  chr4:1538540-1538618
  Hypo

SEQ ID NO: 123043 - DNA, 66 bp, Homo sapiens; identical to SEQ ID NO: 91758
  chr4:1555624-1555690
  Hypo

SEQ ID NO: 123044 - DNA, 110 bp, Homo sapiens; identical to SEQ ID NO: 40191
  chr4:1556398-1556508
  Hypo

SEQ ID NO: 123045 - DNA, 64 bp, Homo sapiens; identical to SEQ ID NO: 91766
  chr4:1556783-1556847
  Hypo

SEQ ID NO: 123046 - DNA, 275 bp, Homo sapiens; identical to SEQ ID NO: 91769
  chr4:1561925-1562200
  Hypo

SEQ ID NO: 123047 - DNA, 30 bp, Homo sapiens; identical to SEQ ID NO: 91772
  chr4:1564339-1564369
  Hypo

SEQ ID NO: 123048 - DNA, 250 bp, Homo sapiens; identical to SEQ ID NO: 40193
  chr4:1576408-1576658
  Hypo

SEQ ID NO: 123049 - DNA, 406 bp, Homo sapiens; identical to SEQ ID NO: 91786
  chr4:1577697-1578103
  Hypo

SEQ ID NO: 123050 - DNA, 104 bp, Homo sapiens; identical to SEQ ID NO: 91788
  chr4:1578710-1578814
  Hypo

SEQ ID NO: 123051 - DNA, 46 bp, Homo sapiens; identical to SEQ ID NO: 91804
  chr4:1598363-1598409
  Hypo

SEQ ID NO: 123052 - DNA, 30 bp, Homo sapiens; identical to SEQ ID NO: 91806
  chr4:1603751-1603781
  Hypo

SEQ ID NO: 123053 - DNA, 179 bp, Homo sapiens; identical to SEQ ID NO: 91807
  chr4:1605588-1605767
  Hypo

SEQ ID NO: 123054 - DNA, 305 bp, Homo sapiens; identical to SEQ ID NO: 91808
  chr4:1608336-1608641
  Hypo

SEQ ID NO: 123055 - DNA, 30 bp, Homo sapiens; identical to SEQ ID NO: 91815
  chr4:1614181-1614211
  Hypo

SEQ ID NO: 123056 - DNA, 560 bp, Homo sapiens; identical to SEQ ID NO: 91816
  chr4:1616533-1617093
  Hypo

SEQ ID NO: 123057 - DNA, 81 bp, Homo sapiens; identical to SEQ ID NO: 91818
  chr4:1623676-1623757
  Hypo

SEQ ID NO: 123058 - DNA, 30 bp, Homo sapiens; identical to SEQ ID NO: 91825
  chr4:1649418-1649448
  Hypo

SEQ ID NO: 123059 - DNA, 136 bp, Homo sapiens; identical to SEQ ID NO: 91830
  chr4:1663439-1663575
  Hypo

SEQ ID NO: 123060 - DNA, 30 bp, Homo sapiens; identical to SEQ ID NO: 91844
  chr4:1684775-1684805
  Hypo

SEQ ID NO: 123061 - DNA, 55 bp, Homo sapiens; identical to SEQ ID NO: 91845
  chr4:1686695-1686750
  Hypo

SEQ ID NO: 123062 - DNA, 399 bp, Homo sapiens; identical to SEQ ID NO: 91846
  chr4:1687080-1687479
  Hypo

SEQ ID NO: 123063 - DNA, 30 bp, Homo sapiens; identical to SEQ ID NO: 91859
  chr4:1719182-1719212
  Hypo

SEQ ID NO: 123064 - DNA, 30 bp, Homo sapiens; identical to SEQ ID NO: 91895
  chr4:1752186-1752216
  Hypo

SEQ ID NO: 123065 - DNA, 30 bp, Homo sapiens; identical to SEQ ID NO: 91896
  chr4:1752494-1752524
  Hypo

SEQ ID NO: 123066 - DNA, 30 bp, Homo sapiens; identical to SEQ ID NO: 91897
  chr4:1753599-1753629
  Hypo

SEQ ID NO: 123067 - DNA, 30 bp, Homo sapiens; identical to SEQ ID NO: 91921
  chr4:1788923-1788953
  Hypo

SEQ ID NO: 123068 - DNA, 75 bp, Homo sapiens; identical to SEQ ID NO: 91922
  chr4:1791269-1791344
  Hypo

SEQ ID NO: 123069 - DNA, 109 bp, Homo sapiens; identical to SEQ ID NO: 91924
  chr4:1796489-1796598
  Hyper

SEQ ID NO: 123070 - DNA, 649 bp, Homo sapiens; identical to SEQ ID NO: 91925
  chr4:1803127-1803776
  Hypo

SEQ ID NO: 123071 - DNA, 155 bp, Homo sapiens; identical to SEQ ID NO: 91926
  chr4:1804729-1804884
  Hypo

SEQ ID NO: 123072 - DNA, 546 bp, Homo sapiens; identical to SEQ ID NO: 91927
  chr4:1805091-1805637
  Hypo

SEQ ID NO: 123073 - DNA, 106 bp, Homo sapiens; identical to SEQ ID NO: 91928
  chr4:1805886-1805992
  Hypo

SEQ ID NO: 123074 - DNA, 436 bp, Homo sapiens; identical to SEQ ID NO: 91929
  chr4:1807256-1807692
  Hypo

SEQ ID NO: 123075 - DNA, 58 bp, Homo sapiens; identical to SEQ ID NO: 91934
  chr4:1811789-1811847
  Hyper

SEQ ID NO: 123076 - DNA, 30 bp, Homo sapiens; identical to SEQ ID NO: 91937
  chr4:1827297-1827327
  Hypo

SEQ ID NO: 123077 - DNA, 365 bp, Homo sapiens
  chr4:1864167-1864532
  Hyper
gtgggcagcaatggccgcgcgccctgctctgggtggtcccgaccccggggaagtccctgtgcagaacgggggctgcgggggcggcaggaggaagtggggggcgcggcacccaggcctcgctgtcttccctttcccttcgagggacctcgcgctgcaaaatccgaagagcccggctggggcggggtcgcggggtgcgcgggaaccggggcctgggacggggcggggcctagccagggcctccacggaagcgaggccaggactggggagtggggggtgggggggtcgtggctgagtgggtgccctgagggcggtcaaggaccccgcgggcctcttctcctgcctggacactgcgcttgcctggctat

SEQ ID NO: 123078 - DNA, 30 bp, Homo sapiens; identical to SEQ ID NO: 91999
  chr4:1958502-1958532
  Hypo

SEQ ID NO: 123079 - DNA, 291 bp, Homo sapiens; identical to SEQ ID NO: 92000
  chr4:1960087-1960378
  Hypo

SEQ ID NO: 123080 - DNA, 30 bp, Homo sapiens; identical to SEQ ID NO: 92001
  chr4:1960796-1960826
  Hypo

SEQ ID NO: 123081 - DNA, 80 bp, Homo sapiens; identical to SEQ ID NO: 92002
  chr4:1961324-1961404
  Hypo

SEQ ID NO: 123082 - DNA, 187 bp, Homo sapiens; identical to SEQ ID NO: 92003
  chr4:1976939-1977126
  Hypo

SEQ ID NO: 123083 - DNA, 100 bp, Homo sapiens; identical to SEQ ID NO: 92004
  chr4:1977425-1977525
  Hypo

SEQ ID NO: 123084 - DNA, 620 bp, Homo sapiens; identical to SEQ ID NO: 40207
  chr4:1993715-1994335
  Hypo

SEQ ID NO: 123085 - DNA, 85 bp, Homo sapiens; identical to SEQ ID NO: 92006
  chr4:1994745-1994830
  Hypo

SEQ ID NO: 123086 - DNA, 98 bp, Homo sapiens; identical to SEQ ID NO: 92007
  chr4:1999785-1999883
  Hypo

SEQ ID NO: 123087 - DNA, 30 bp, Homo sapiens; identical to SEQ ID NO: 40209
  chr4:2009272-2009302
  Hypo

SEQ ID NO: 123088 - DNA, 30 bp, Homo sapiens; identical to SEQ ID NO: 92017
  chr4:2038336-2038366
  Hypo

SEQ ID NO: 123089 - DNA, 615 bp, Homo sapiens
  chr4:2042116-2042731
  Hyper
gtgggcgcgactgtccgtgggcgctaggggcaggggtgataggagcaggtcgcgagcgggcgcagcgtgggaccgaaggggagaaggacgcctgcggcccggcgcgtccccggaggcacgtcccccccagggctccgcggccccggcaacagcgcggggctacccctctacggctcccgccccactgggggaccgcgacggcctgctcccgggctcttggctccgagtggagaagagcgcggaagtgcgcactagcccgacactcgggagggccgctgcctccccaggcgcctgggacagcggcccgcagcccccacccggcccctcgggccccgcgtgcgtttcagcgcgctgaggatgcagcacacccccgaggtgcgaccgggtccccgaagcccggcgtcggcccaacccggaggaggcagcggcagtcacgggcacgcttccccaacccaccctcccacccactcttagggtcaggacacccgcgtccggccggggcaggggcggctctgaccacgcgagaagcaggtgcgtccgcagtcccagcttgtgccgggaagaccaccggccagaaccccgggggttgggggtagaggtcggctaggctgggga

SEQ ID NO: 123090 - DNA, 105 bp, Homo sapiens; identical to SEQ ID NO: 92021
  chr4:2043082-2043187
  Hyper

SEQ ID NO: 123091 - DNA, 30 bp, Homo sapiens; identical to SEQ ID NO: 92022
  chr4:2043417-2043447
  Hyper

SEQ ID NO: 123092 - DNA, 182 bp, Homo sapiens; identical to SEQ ID NO: 92023
  chr4:2048726-2048908
  Hyper

SEQ ID NO: 123093 - DNA, 558 bp, Homo sapiens
  chr4:2059984-2060542
  Hyper
gtggaccagttcagccgcccctccccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccccgtcccgcccgcgcatgtcggggaagctctgctccggcagccctcggggtggtgctgggaggtcgcgcagaactgaagggggctaggttcgagaagcgccgaggatggggtctgcgaccgcctccccgcacctgagcttctccgccccagcctgcggcgtctgcaggtcctacaaggcgcagagcccccgctgcacctgcaccgaggccacggggcgcatgcgcggccgcggggggcgggggccgggccgggaggggtcctgcgggccccgcatccccgtgcccactgcggggctcggacaggggggcgccgcgccaggccgcagaccccgcccttccgcgtccccactccggctgcccgtgcggctccggacgaggcttcccgggg

SEQ ID NO: 123094 - DNA, 672 bp, Homo sapiens; identical to SEQ ID NO: 92026
  chr4:2061476-2062148
  Hyper

SEQ ID NO: 123095 - DNA, 712 bp, Homo sapiens; identical to SEQ ID NO: 92027
  chr4:2065587-2066299
  Hypo

SEQ ID NO: 123096 - DNA, 91 bp, Homo sapiens; identical to SEQ ID NO: 92028
  chr4:2129361-2129452
  Hypo

SEQ ID NO: 123097 - DNA, 30 bp, Homo sapiens; identical to SEQ ID NO: 92033
  chr4:2251665-2251695
  Hypo

SEQ ID NO: 123098 - DNA, 141 bp, Homo sapiens; identical to SEQ ID NO: 40213
  chr4:2278785-2278926
  Hypo

SEQ ID NO: 123099 - DNA, 332 bp, Homo sapiens; identical to SEQ ID NO: 92037
  chr4:2288990-2289322
  Hypo

SEQ ID NO: 123100 - DNA, 30 bp, Homo sapiens; identical to SEQ ID NO: 92038
  chr4:2290228-2290258
  Hypo

SEQ ID NO: 123101 - DNA, 333 bp, Homo sapiens; identical to SEQ ID NO: 40214
  chr4:2305585-2305918
  Hypo

SEQ ID NO: 123102 - DNA, 107 bp, Homo sapiens; identical to SEQ ID NO: 28710
  chr4:2418673-2418780
  Hyper

SEQ ID NO: 123103 - DNA, 44 bp, Homo sapiens; identical to SEQ ID NO: 92041
  chr4:2418988-2419032
  Hyper

SEQ ID NO: 123104 - DNA, 148 bp, Homo sapiens; identical to SEQ ID NO: 92046
  chr4:2459751-2459899
  Hypo

SEQ ID NO: 123105 - DNA, 30 bp, Homo sapiens; identical to SEQ ID NO: 92047
  chr4:2460473-2460503
  Hypo

SEQ ID NO: 123106 - DNA, 30 bp, Homo sapiens; identical to SEQ ID NO: 92055
  chr4:2514698-2514728
  Hypo

SEQ ID NO: 123107 - DNA, 21 bp, Homo sapiens
  chr4:2526051-2526072
  Hypo
agacttcgtctcaaaaaaaaa

SEQ ID NO: 123108 - DNA, 35 bp, Homo sapiens; identical to SEQ ID NO: 14672
  chr4:2527902-2527937
  Hypo

SEQ ID NO: 123109 - DNA, 92 bp, Homo sapiens; identical to SEQ ID NO: 92059
  chr4:2540246-2540338
  Hypo

SEQ ID NO: 123110 - DNA, 30 bp, Homo sapiens; identical to SEQ ID NO: 92066
  chr4:2626134-2626164
  Hypo

SEQ ID NO: 123111 - DNA, 60 bp, Homo sapiens; identical to SEQ ID NO: 92068
  chr4:2688393-2688453
  Hypo

SEQ ID NO: 123112 - DNA, 30 bp, Homo sapiens; identical to SEQ ID NO: 92071
  chr4:2746348-2746378
  Hypo

SEQ ID NO: 123113 - DNA, 30 bp, Homo sapiens; identical to SEQ ID NO: 92072
  chr4:2763047-2763077
  Hypo

SEQ ID NO: 123114 - DNA, 449 bp, Homo sapiens; identical to SEQ ID NO: 28711
  chr4:2765778-2766227
  Hyper

SEQ ID NO: 123115 - DNA, 30 bp, Homo sapiens; identical to SEQ ID NO: 92074
  chr4:2915308-2915338
  Hypo

SEQ ID NO: 123116 - DNA, 114 bp, Homo sapiens; identical to SEQ ID NO: 40217
  chr4:2926282-2926396
  Hypo

SEQ ID NO: 123117 - DNA, 52 bp, Homo sapiens; identical to SEQ ID NO: 92076
  chr4:2930363-2930415
  Hypo

SEQ ID NO: 123118 - DNA, 247 bp, Homo sapiens; identical to SEQ ID NO: 92077
  chr4:2932839-2933086
  Hypo

SEQ ID NO: 123119 - DNA, 48 bp, Homo sapiens; identical to SEQ ID NO: 92078
  chr4:2978950-2978998
  Hypo

SEQ ID NO: 123120 - DNA, 45 bp, Homo sapiens; identical to SEQ ID NO: 40220
  chr4:2987431-2987476
  Hypo

SEQ ID NO: 123121 - DNA, 30 bp, Homo sapiens; identical to SEQ ID NO: 92090
  chr4:3177345-3177375
  Hypo

SEQ ID NO: 123122 - DNA, 54 bp, Homo sapiens; identical to SEQ ID NO: 92091
  chr4:3252743-3252797
  Hypo

SEQ ID NO: 123123 - DNA, 187 bp, Homo sapiens; identical to SEQ ID NO: 92092
  chr4:3285790-3285977
  Hypo

SEQ ID NO: 123124 - DNA, 134 bp, Homo sapiens; identical to SEQ ID NO: 92093
  chr4:3286580-3286714
  Hypo

SEQ ID NO: 123125 - DNA, 167 bp, Homo sapiens; identical to SEQ ID NO: 92094
  chr4:3292632-3292799
  Hypo

SEQ ID NO: 123126 - DNA, 32 bp, Homo sapiens; identical to SEQ ID NO: 92095
  chr4:3301969-3302001
  Hypo

SEQ ID NO: 123127 - DNA, 57 bp, Homo sapiens; identical to SEQ ID NO: 92097
  chr4:3310494-3310551
  Hypo

SEQ ID NO: 123128 - DNA, 144 bp, Homo sapiens; identical to SEQ ID NO: 92098
  chr4:3313229-3313373
  Hypo

SEQ ID NO: 123129 - DNA, 203 bp, Homo sapiens; identical to SEQ ID NO: 92099
  chr4:3313433-3313636
  Hypo

SEQ ID NO: 123130 - DNA, 30 bp, Homo sapiens; identical to SEQ ID NO: 92101
  chr4:3417466-3417496
  Hypo

SEQ ID NO: 123131 - DNA, 44 bp, Homo sapiens; identical to SEQ ID NO: 92102
  chr4:3418235-3418279
  Hypo

SEQ ID NO: 123132 - DNA, 30 bp, Homo sapiens; identical to SEQ ID NO: 92103
  chr4:3425872-3425902
  Hypo

SEQ ID NO: 123133 - DNA, 33 bp, Homo sapiens; identical to SEQ ID NO: 92104
  chr4:3441235-3441268
  Hypo

SEQ ID NO: 123134 - DNA, 336 bp, Homo sapiens; identical to SEQ ID NO: 92105
  chr4:3445886-3446222
  Hypo

SEQ ID NO: 123135 - DNA, 727 bp, Homo sapiens; identical to SEQ ID NO: 92106
  chr4:3446443-3447170
  Hypo

SEQ ID NO: 123136 - DNA, 235 bp, Homo sapiens; identical to SEQ ID NO: 92107
  chr4:3447780-3448015
  Hypo

SEQ ID NO: 123137 - DNA, 30 bp, Homo sapiens; identical to SEQ ID NO: 40229
  chr4:3449723-3449753
  Hypo

SEQ ID NO: 123138 - DNA, 30 bp, Homo sapiens; identical to SEQ ID NO: 92109
  chr4:3465854-3465884
  Hypo

SEQ ID NO: 123139 - DNA, 195 bp, Homo sapiens; identical to SEQ ID NO: 92110
  chr4:3467304-3467499
  Hypo

SEQ ID NO: 123140 - DNA, 326 bp, Homo sapiens; identical to SEQ ID NO: 92111
  chr4:3475077-3475403
  Hypo

SEQ ID NO: 123141 - DNA, 58 bp, Homo sapiens; identical to SEQ ID NO: 92112
  chr4:3479511-3479569
  Hypo

SEQ ID NO: 123142 - DNA, 53 bp, Homo sapiens; identical to SEQ ID NO: 92113
  chr4:3534408-3534461
  Hyper

SEQ ID NO: 123143 - DNA, 17 bp, Homo sapiens
  chr4:3565396-3565413
  Hypo
caagactgtgacacacg

SEQ ID NO: 123144 - DNA, 133 bp, Homo sapiens; identical to SEQ ID NO: 92116
  chr4:3603530-3603663
  Hypo

SEQ ID NO: 123145 - DNA, 142 bp, Homo sapiens; identical to SEQ ID NO: 92117
  chr4:3609066-3609208
  Hypo

SEQ ID NO: 123146 - DNA, 30 bp, Homo sapiens; identical to SEQ ID NO: 92118
  chr4:3616292-3616322
  Hypo

SEQ ID NO: 123147 - DNA, 30 bp, Homo sapiens; identical to SEQ ID NO: 92123
  chr4:3652102-3652132
  Hypo

SEQ ID NO: 123148 - DNA, 30 bp, Homo sapiens; identical to SEQ ID NO: 92124
  chr4:3654274-3654304
  Hypo

SEQ ID NO: 123149 - DNA, 61 bp, Homo sapiens; identical to SEQ ID NO: 92125
  chr4:3664470-3664531
  Hypo

SEQ ID NO: 123150 - DNA, 77 bp, Homo sapiens; identical to SEQ ID NO: 92126
  chr4:3690825-3690902
  Hypo

SEQ ID NO: 123151 - DNA, 184 bp, Homo sapiens; identical to SEQ ID NO: 92127
  chr4:3702485-3702669
  Hypo

SEQ ID NO: 123152 - DNA, 912 bp, Homo sapiens; identical to SEQ ID NO: 92134
  chr4:3767295-3768207
  Hyper

SEQ ID NO: 123153 - DNA, 804 bp, Homo sapiens
  chr4:3768818-3769622
  Hyper
gcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacag

SEQ ID NO: 123154 - DNA, 30 bp, Homo sapiens; identical to SEQ ID NO: 40234
  chr4:3782694-3782724
  Hypo

SEQ ID NO: 123155 - DNA, 270 bp, Homo sapiens; identical to SEQ ID NO: 92139
  chr4:3783050-3783320
  Hypo

SEQ ID NO: 123156 - DNA, 30 bp, Homo sapiens; identical to SEQ ID NO: 92140
  chr4:3783791-3783821
  Hypo

SEQ ID NO: 123157 - DNA, 30 bp, Homo sapiens; identical to SEQ ID NO: 92144
  chr4:3864547-3864577
  Hyper

SEQ ID NO: 123158 - DNA, 771 bp, Homo sapiens; identical to SEQ ID NO: 92146
  chr4:3873077-3873848
  Hyper

SEQ ID NO: 123159 - DNA, 154 bp, Homo sapiens; identical to SEQ ID NO: 28718
  chr4:3882096-3882250
  Hyper

SEQ ID NO: 123160 - DNA, 147 bp, Homo sapiens; identical to SEQ ID NO: 92150
  chr4:3925878-3926025
  Hypo

SEQ ID NO: 123161 - DNA, 551 bp, Homo sapiens
  chr4:4144902-4145453
  Hyper
gctccggggctggggcgcgtgctaggggcccgcggggtttcagctgtattttcgaacccctgtgcttggccgaggggttcccaaggctccactccgccttggagggggctgcggaagcccggaggtgacacgggctctgggaggggcgtccccaacgtgggggaggggtgacaggggcctttgaagacagcgcgggactaggagggggtgcccccgacctaagtcgtggtaaactgaggccggcgaggagggaggctgagtccggggaccaggcggcccctcgctgctcctcgggccagtcgcccccctgcgcctgttcgtacgggcagggccggcggccgagtccagcgggctcggggccaggccggggtcccgcgggcggcgcctcctcctccgcggcgtccccatactcgccctccgcgtcgctctcgtccgagttgtcctcctccaagtagcggtcaccgcgcaccttgtgctggggccgcgggatgtggggctagcgcggggccatgccccgccgcagcttctgctccatccgcaggtaggagacc

SEQ ID NO: 123162 - DNA, 30 bp, Homo sapiens; identical to SEQ ID NO: 92197
  chr4:4221107-4221137
  Hypo

SEQ ID NO: 123163 - DNA, 290 bp, Homo sapiens
  chr4:4227985-4228275
  Hyper
aggaggctcctgcggcgacccaagcttcagagagagagagaggaaaggaagggcagacaggaaagctaggaaagatgcacagagagaccaaggcagaaaaggctgaagggaagacggcagcggtaggaagggcgcagagcagcctcaggatgcagccagcgggcgaggaggcggagacccgctcgcccggcgcctggactcaccgcgcagccagccggcacccgcgtgcgtgtccttgaggcggaagaggcggcggtgcgcggagctgcggcccacgtaccacagcatcc

SEQ ID NO: 123164 - DNA, 56 bp, Homo sapiens; identical to SEQ ID NO: 92200
  chr4:4229330-4229386
  Hyper

SEQ ID NO: 123165 - DNA, 362 bp, Homo sapiens; identical to SEQ ID NO: 92201
  chr4:4229586-4229948
  Hyper

SEQ ID NO: 123166 - DNA, 23 bp, Homo sapiens
  chr4:4251225-4251248
  Hypo
gaaaagagtgccagccgcgcgcg

SEQ ID NO: 123167 - DNA, 30 bp, Homo sapiens; identical to SEQ ID NO: 40236
  chr4:4251746-4251776
  Hypo

SEQ ID NO: 123168 - DNA, 82 bp, Homo sapiens; identical to SEQ ID NO: 14678
  chr4:4256159-4256241
  Hypo

SEQ ID NO: 123169 - DNA, 1551 bp, Homo sapiens
  chr4:4387460-4389011
  Hyper
gtcacctgtcaaagacggctagccctcctggggattttgaaatcagggcacccgcggcaagttcccaggctgtgcctggggctcaaggcggtggctgctcctgtgctctgggcttattcccaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggcgcagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggtgagtgcggccggccgcgcctgggcttgccgaggccagaccttgcccgcccaggagcagtgcccgggggatgcccatctcccggagtacgcgggacggggctgtgaacag

SEQ ID NO: 123170 - DNA, 66 bp, Homo sapiens; identical to SEQ ID NO: 92211
  chr4:4389231-4389297
  Hyper

SEQ ID NO: 123171 - DNA, 30 bp, Homo sapiens; identical to SEQ ID NO: 92212
  chr4:4389764-4389794
  Hyper

SEQ ID NO: 123172 - DNA, 448 bp, Homo sapiens; identical to SEQ ID NO: 92213
  chr4:4417485-4417933
  Hypo

SEQ ID NO: 123173 - DNA, 146 bp, Homo sapiens; identical to SEQ ID NO: 92222
  chr4:4614181-4614327
  Hypo

SEQ ID NO: 123174 - DNA, 41 bp, Homo sapiens; identical to SEQ ID NO: 92225
  chr4:4675041-4675082
  Hypo

SEQ ID NO: 123175 - DNA, 37 bp, Homo sapiens; identical to SEQ ID NO: 92233
  chr4:4753216-4753253
  Hypo

SEQ ID NO: 123176 - DNA, 38 bp, Homo sapiens; identical to SEQ ID NO: 92240
  chr4:4854394-4854432
  Hyper

SEQ ID NO: 123177 - DNA, 1048 bp, Homo sapiens
  chr4:4854669-4855717
  Hyper
ctctcctgcctgggccgacccggcgctttactgcttctcacgaaggtgcgccggctgctccagaaatcgcagactgcctccaggaagaacttgctggagtcacagcagcttctcagcgacttgacagcagtgattcagacttcaacttgggcggaggggcgggggaggagaaagagatttccagagaaaacgactgagcggtagggaggggaagagagaccgagccacgcgcctcgagaagcagtgcagagagcggaagagacagaggctgcgagacctacccacagagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactcccacacaccaggctgtccgcgggccgccttgtcacagaaaggcagctccccagccccgcagagtcccgacagctgcccccgcgaaggtggggcgaggggcggcttttccgggggaaactctctccctggacgcccctcctttccagcctcagctctggcctttctcggcatccccagcttgccttcagtttcactccatatctgggtctctcagaggcctcgggaggtcttccgttctctctgtcgccgtgtccacggaaggagcctccccaaccctctgtggctccgcgcctcttgggccggagcatctctgtcttccggagtctcttgatcattgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggagcataagagaaaagtagtgagtacgggcccaaagacccatttcgtggattgggggagggacggggaggctgttcc

SEQ ID NO: 123178 - DNA, 173 bp, Homo sapiens; identical to SEQ ID NO: 92243
  chr4:4858694-4858867
  Hyper

SEQ ID NO: 123179 - DNA, 179 bp, Homo sapiens
  chr4:4859646-4859825
  Hyper
gaggccccggtgcaccgcgcgtccagccggcccaactcgagctagaagccccaaccactgcccagtgcctgagttgcagtcttgggtcctttagaaacctggagatgtgcgtaaaattcagatgccggtattcccgaacttccccaggcctcagcatatctcggcggcctgtggacaga

SEQ ID NO: 123180 - DNA, 51 bp, Homo sapiens; identical to SEQ ID NO: 92246
  chr4:4861085-4861136
  Hyper

SEQ ID NO: 123181 - DNA, 226 bp, Homo sapiens; identical to SEQ ID NO: 28731
  chr4:4861342-4861568
  Hyper

SEQ ID NO: 123182 - DNA, 1532 bp, Homo sapiens; identical to SEQ ID NO: 92248
  chr4:4861780-4863312
  Hyper

SEQ ID NO: 123183 - DNA, 185 bp, Homo sapiens; identical to SEQ ID NO: 28735
  chr4:4867591-4867776
  Hyper

SEQ ID NO: 123184 - DNA, 98 bp, Homo sapiens; identical to SEQ ID NO: 92250
  chr4:4868024-4868122
  Hyper

SEQ ID NO: 123185 - DNA, 987 bp, Homo sapiens
  chr4:4868537-4869524
  Hyper
gaggaatgataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacctcgcgctaagagcgccttactttaaggttagtttctcggatcgctgaacccggggctgaaggaccagattgagcaggaggcccagtgaggacagttactggtgaggcaggggccccgagtgcgaatcctaccgctgcgccctccttagtgacccaaggccgggaggtgagcccagccgggtccaggcctgcgccccgcctagagccctcgggggcgcaataggaagcggcgaggagaggccgcggccgcctttcaactctgcggctggcgccggcctggccgggcccccgaggccgcgcggcctccaaggttccgtcccgccctcccagacgctcagctcgcatcgccccacagtggaacagtcccccggccccgacgccggactccctgggaagcccccgacccccaagtgccaccaccaagtgcccactctccagagcactcccaggcccccactccagacttgcggaatttgttccgctccactcaacagctcccacgcctgccgcgcactccgcccccttcccaggcccagggggaccctgcctccaccccgcctgcctcccccacagcgccctcccgcggccctcagctcacagccagctctcccagcgcctgctcactgtagttccggtgctggacgctggccttggctccctgcgttacaagtagatcctcaagtgcgcacacgcacacgaccaacacacgtcatccacacgacataccaacaca

SEQ ID NO: 123186 - DNA, 189 bp, Homo sapiens; identical to SEQ ID NO: 92255
  chr4:4870045-4870234
  Hyper

SEQ ID NO: 123187 - DNA, 69 bp, Homo sapiens; identical to SEQ ID NO: 92256
  chr4:4871315-4871384
  Hyper

SEQ ID NO: 123188 - DNA, 461 bp, Homo sapiens
  chr4:4871754-4872215
  Hyper
cgcgggttatcccaacgaatcctcactaccaggtgggcacgtgccattgtgacccgtgtcatagactgaagcatagagagttgaatgactcagacaagatcacacagctagtgagagtgaaacagagcttccaactcagacagccggtgccaccatctggcgcccctaaatctcagttccctggtccgcggaatgggaacactttcgggctggtgcagaggaaactatgggtgactccaaaggcagcgcgcggtaagaactccgggtgagaaggggagcgcgcgaggagagcgccaagcgtagcgcggagcatagaggcaggatggtgacctgagcgctctttgctggccggctctgctctccgcagcgccattggaattccttactctccagtcccccgagggtgtgtgtgggtgaggggaggtccctgaggcggaagggatgagcggagtggaagcgga

SEQ ID NO: 123189 - DNA, 34 bp, Homo sapiens; identical to SEQ ID NO: 92259
  chr4:4872457-4872491
  Hyper

SEQ ID NO: 123190 - DNA, 132 bp, Homo sapiens; identical to SEQ ID NO: 92260
  chr4:4872777-4872909
  Hyper

SEQ ID NO: 123191 - DNA, 342 bp, Homo sapiens; identical to SEQ ID NO: 92261
  chr4:4873139-4873481
  Hyper

SEQ ID NO: 123192 - DNA, 121 bp, Homo sapiens; identical to SEQ ID NO: 92265
  chr4:5052435-5052556
  Hyper

SEQ ID NO: 123193 - DNA, 1260 bp, Homo sapiens; identical to SEQ ID NO: 92266
  chr4:5052845-5054105
  Hyper

SEQ ID NO: 123194 - DNA, 172 bp, Homo sapiens; identical to SEQ ID NO: 92267
  chr4:5160791-5160963
  Hypo

SEQ ID NO: 123195 - DNA, 174 bp, Homo sapiens; identical to SEQ ID NO: 92268
  chr4:5171284-5171458
  Hypo

SEQ ID NO: 123196 - DNA, 30 bp, Homo sapiens; identical to SEQ ID NO: 40240
  chr4:5458789-5458819
  Hypo

SEQ ID NO: 123197 - DNA, 30 bp, Homo sapiens; identical to SEQ ID NO: 92277
  chr4:5464682-5464712
  Hypo

SEQ ID NO: 123198 - DNA, 796 bp, Homo sapiens
  chr4:5709732-5710528
  Hyper
ccctaggtcgaagctcgtaaaatggagagcaggattcgaaccagggtcgctggtgaagtccaagccggcagctgccacaccccgaggaaggtctccagtttccctcgaagctttctggccgtgagcgggatacacctaagggccgcgaagcaccctattcagatcctgccctcccttcctcattctttgcgaaatactaagggtcctccctgccaccgccggtgtagacaaagtcaaaccactacagtcagaccggagcctggggtcgggccctccttacctgcgtgctgctctcgggccccgccccgctccgccccggagggatcctcaggccgggcccagacctaggagccacctggggatcccggggtggctgcgcgccgagggggcgccagcggggacgtgagctggcgccgagacagcctcggccccccagcgccagggccactgccaggagacccccggccagcacccacgtggggcgcccccgggagcccgaggggtccatcgcctgtcgggacccgctacctcaaagcggcgggtgccgccgagtcgctggagcttccggaccccaggcccgccccgccgccgagcatgctcagtgcgagccgccgccgaaagttttctggaacaaacacccgcatctggggcttggcgggccaggaggtgccggacgggcgtgggagggggagagcgagttggcgcggcccaggcgcccggcggccaggcctgggtttgcttgcgcccaaaccgaatcagagcgggtcactcccctgctccccgaggttaccaggac

SEQ ID NO: 123199 - DNA, 443 bp, Homo sapiens
  chr4:5712891-5713334
  Hyper
gctgaaagttttgagcggtgatccaggctcctccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccgagcagacagcggcggggcggggagcgcggggcgcgtggctt

SEQ ID NO: 123200 - DNA, 1490 bp, Homo sapiens; identical to SEQ ID NO: 28748
  chr4:5889116-5890606
  Hyper

SEQ ID NO: 123201 - DNA, 334 bp, Homo sapiens
  chr4:5891895-5892229
  Hyper
aagtcctaggttccccgtaccagggcgttccctggggtcagtctggagatctgagcagaaagcccctacagcaagggacaagaccacgtgcgtatcagggggaggagcatccgcctgccactggccaaacagatcgctgctcccaagcagatttcgccggtacaaagcgccgcagccgctcagcctccggcagcggcaatccttgcgcctgcgccgcagaaacccctcctgcagcccagggagaagcctggtgggcggggggggaagggccggggcacccgttgcgaagccctggagcggtgaggcccgccccggaacccgagcccactgtaac

SEQ ID NO: 123202 - DNA, 182 bp, Homo sapiens; identical to SEQ ID NO: 92354
  chr4:5892520-5892702
  Hyper

SEQ ID NO: 123203 - DNA, 317 bp, Homo sapiens; identical to SEQ ID NO: 92355
  chr4:5893437-5893754
  Hyper

SEQ ID NO: 123204 - DNA, 432 bp, Homo sapiens
  chr4:5893981-5894413
  Hyper
ccagaggttccttcgcgtttaagcgtccatgcggtagctttagccaacttcccctctcagaacctctctccctttctgtagaagaggagccgggactggacccgggcgatcccttccgagtctcacggaccacgccggccagccccgaccgagtcgccccagctctgggaacctcttgcatgatgaggtgggggaggggccgcgccgtggctctccccagcctggcggccgctgccccaacaccggggcccgggcatggccctcgggcgccccatgccctgggtcctcccggggcccgcccccctcgtctggcccgcgcgcgccccgagggtacctggccattgtcccggccgaggggcaggtcgcggggcgcggggcggcggatgcgcagcgtcggcggccgctcgtcgcgctctccgggagagctgaccg

SEQ ID NO: 123205 - DNA, 494 bp, Homo sapiens
  chr4:5894635-5895129
  Hyper
gccgcgccaggtacacgggcaggtcgtcctcggtgttccacgcgcgccgccggtccgccatacccgtccaaggccggccacccaccgcgctcccgcctgcccgcccgcggccctgggcaccgccgtgcgccgcgctccgcgcctcggtgcgggcctgcggcggcccgggcgcgactgcggcccagggaggggaggggcggggcgtggcgcgcgccggggcggggccggggcggggcctctgggcggctgcgggctagcggcgcggccagctacaaaggaccaggaggcggggatcgcggctggggcggggagggacggtgacgctcccgagccgcagcgcggagggcgggccgcggcaccgcagtgccctcgccgcaccccccactctccgcccccaggcggagcgcagggcgcgaggagagcgcggggcaggagccgtgtgcgtacactcgcgcgcccacacgctctggaggcacacgcgggttcatacctgc

SEQ ID NO: 123206 - DNA, 30 bp, Homo sapiens; identical to SEQ ID NO: 92358
  chr4:6019884-6019914
  Hypo

SEQ ID NO: 123207 - DNA, 160 bp, Homo sapiens; identical to SEQ ID NO: 92359
  chr4:6032062-6032222
  Hypo

SEQ ID NO: 123208 - DNA, 169 bp, Homo sapiens; identical to SEQ ID NO: 92363
  chr4:6176884-6177053
  Hypo

SEQ ID NO: 123209 - DNA, 30 bp, Homo sapiens; identical to SEQ ID NO: 92365
  chr4:6195587-6195617
  Hypo

SEQ ID NO: 123210 - DNA, 845 bp, Homo sapiens
  chr4:6200828-6201673
  Hyper
cagctgaagttagggcgttcgcggagagagcacagcactggcaaaggccaaggacagtgtgcctgcgagtgtgcgcagatggggcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgccggcccggcaggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctg

SEQ ID NO: 123211 - DNA, 779 bp, Homo sapiens; identical to SEQ ID NO: 92368
  chr4:6201879-6202658
  Hyper

SEQ ID NO: 123212 - DNA, 744 bp, Homo sapiens
  chr4:6223447-6224191
  Hyper
tctggaaaggactcccggagagcagctgctctgaattttctaatttcgctacactggtgatgtatcatgtattcctgtgtgattcgaaaatgttaaaagtcatataataatgtagaagacgacccttcgcgagcgaggccccccacctctggccactgagggcacttacgtaactgcggggcgggcgcaggcctccactgggtgagcggcaggcgggggcggggctgcccggagcctcggccccgcccacccctctcccccgcccactgtccccgcccagccccgggctgctcggaaaggccggagtccggagcacagcaacgcgcggagcggcccggcccctctggtggtcccgcccacgcgacccgggcgcagcggcgggcgccggacagctgtcccggcgggcgaacgacatgcagcggaactgcgggaggctgcggttcggtggctggacttgcgtcccccacctcctctgtcgcgcgtgccctgctccccagtgagggcgtccctgggatgggatctgggcgcccggcgcagcgcggctgacaacagccgagcggttccggtgcgctggcacgtggctcgggcctgcccccccggcctggccgcctcccggcgcgttccccggtgcaggtgcctggcccgtgccccgccatctccgcccggcgccgcctgtgctgaaggagccacgccccgggctccggagcctgcctctgcaaagtccaggcccgcggcgcgcaggtc

SEQ ID NO: 123213 - DNA, 531 bp, Homo sapiens; identical to SEQ ID NO: 92376
  chr4:6247186-6247717
  Hyper

SEQ ID NO: 123214 - DNA, 901 bp, Homo sapiens; identical to SEQ ID NO: 92380
  chr4:6472218-6473119
  Hyper

SEQ ID NO: 123215 - DNA, 30 bp, Homo sapiens; identical to SEQ ID NO: 92381
  chr4:6473457-6473487
  Hyper

SEQ ID NO: 123216 - DNA, 693 bp, Homo sapiens
  chr4:6473794-6474487
  Hyper
atcgcgcggtccaaaccttcggagggcattcggtgcgacggcatccccacgccgcggccggccggaggggtctcagacaacacgtacgttaccttcagtcacatagctgtggtcccgcaggaagctgtggttaattttccgcgtgtccgtgtcctcgcccattgaaggccgtgcccggtgctctgggcatgccccgccgccacacaccgatgcaatccgcagaggtcgcgccgggcgcgcgggccatgccgccgcagcctagcaggggcgcgggccgccggggccccgaagggagggcatcgcggcagggggacgggcgggggcggccgggggcgggcgccgcggtcaagcgagcgcgcggtgggcgggcggcggccgcgggttcgggcgggccggggcccaggcgcgcatcccggccggcccgtgcgcgctgcgtccgtgcgcccggcggcggggcctggtgccggtgcgcctggctgcggcgacggcggcgaggggacgcgcgcggcgctgcgctgcgccgaccaagccggggccgagccgggctgcgcgggctggggccgccgccgccgccgctgtcgcaggcccctccctcgcgccgcccgctctccgcccccgcggccctgcaggtggagccggcgcccaagccgaggctgcaccgccgtgctcgggccctcgcggtgggcaccttgg

SEQ ID NO: 123217 - DNA, 83 bp, Homo sapiens; identical to SEQ ID NO: 92386
  chr4:6525252-6525335
  Hypo

SEQ ID NO: 123218 - DNA, 87 bp, Homo sapiens; identical to SEQ ID NO: 92388
  chr4:6537147-6537234
  Hypo

SEQ ID NO: 123219 - DNA, 193 bp, Homo sapiens; identical to SEQ ID NO: 92389
  chr4:6540136-6540329
  Hypo

SEQ ID NO: 123220 - DNA, 614 bp, Homo sapiens; identical to SEQ ID NO: 92390
  chr4:6564642-6565256
  Hyper

SEQ ID NO: 123221 - DNA, 30 bp, Homo sapiens; identical to SEQ ID NO: 40243
  chr4:6627192-6627222
  Hypo

SEQ ID NO: 123222 - DNA, 34 bp, Homo sapiens; identical to SEQ ID NO: 92399
  chr4:6660444-6660478
  Hyper

SEQ ID NO: 123223 - DNA, 93 bp, Homo sapiens; identical to SEQ ID NO: 92400
  chr4:6670121-6670214
  Hypo

SEQ ID NO: 123224 - DNA, 93 bp, Homo sapiens; identical to SEQ ID NO: 40245
  chr4:6719866-6719959
  Hypo

SEQ ID NO: 123225 - DNA, 228 bp, Homo sapiens; identical to SEQ ID NO: 92403
  chr4:6748346-6748574
  Hypo

SEQ ID NO: 123226 - DNA, 30 bp, Homo sapiens; identical to SEQ ID NO: 92406
  chr4:6771794-6771824
  Hypo

SEQ ID NO: 123227 - DNA, 113 bp, Homo sapiens; identical to SEQ ID NO: 92409
  chr4:6896320-6896433
  Hypo

SEQ ID NO: 123228 - DNA, 30 bp, Homo sapiens; identical to SEQ ID NO: 92411
  chr4:6946432-6946462
  Hypo

SEQ ID NO: 123229 - DNA, 74 bp, Homo sapiens; identical to SEQ ID NO: 92412
  chr4:6957571-6957645
  Hypo

SEQ ID NO: 123230 - DNA, 19 bp, Homo sapiens
  chr4:7035959-7035978
  Hypo
gagacgcagggaaggatgt

SEQ ID NO: 123231 - DNA, 231 bp, Homo sapiens; identical to SEQ ID NO: 92414
  chr4:7047052-7047283
  Hypo

SEQ ID NO: 123232 - DNA, 30 bp, Homo sapiens; identical to SEQ ID NO: 92415
  chr4:7084525-7084555
  Hypo

SEQ ID NO: 123233 - DNA, 34 bp, Homo sapiens; identical to SEQ ID NO: 92416
  chr4:7131141-7131175
  Hypo

SEQ ID NO: 123234 - DNA, 30 bp, Homo sapiens; identical to SEQ ID NO: 40252
  chr4:7134112-7134142
  Hypo

SEQ ID NO: 123235 - DNA, 770 bp, Homo sapiens; identical to SEQ ID NO: 92421
  chr4:7194112-7194882
  Hyper

SEQ ID NO: 123236 - DNA, 362 bp, Homo sapiens
  chr4:7195096-7195458
  Hyper
atcctgggccacctccgatactcccccactggcctccaggtcttgggttacggaggaggaccccagaaccttcggaagcctgcaggtccttgagggtaccccagctcggcgttacctcccctgcccccagactccaccagctgagcgtcgcgttctgggattttgggctccgggatccttccctccctggtctaccagggactccgcggtggcgcctccgcaggctccgggacttccccggtcagctcgaatcctgttctgggactctgggatttctgggttacccctctccccggggtactctagtgcgacccgcggctgtcttgagctcttgctgccggtcgccccgcctggatgcactg

SEQ ID NO: 123237 - DNA, 30 bp, Homo sapiens; identical to SEQ ID NO: 40253
  chr4:7237615-7237645
  Hypo

SEQ ID NO: 123238 - DNA, 206 bp, Homo sapiens; identical to SEQ ID NO: 92426
  chr4:7261017-7261223
  Hypo

SEQ ID NO: 123239 - DNA, 30 bp, Homo sapiens; identical to SEQ ID NO: 92427
  chr4:7282766-7282796
  Hypo

SEQ ID NO: 123240 - DNA, 35 bp, Homo sapiens; identical to SEQ ID NO: 92428
  chr4:7295601-7295636
  Hypo

SEQ ID NO: 123241 - DNA, 32 bp, Homo sapiens; identical to SEQ ID NO: 92429
  chr4:7302270-7302302
  Hypo

SEQ ID NO: 123242 - DNA, 30 bp, Homo sapiens; identical to SEQ ID NO: 92432
  chr4:7376235-7376265
  Hypo

SEQ ID NO: 123243 - DNA, 146 bp, Homo sapiens; identical to SEQ ID NO: 92438
  chr4:7475389-7475535
  Hypo

SEQ ID NO: 123244 - DNA, 30 bp, Homo sapiens; identical to SEQ ID NO: 92442
  chr4:7522096-7522126
  Hypo

SEQ ID NO: 123245 - DNA, 107 bp, Homo sapiens; identical to SEQ ID NO: 92447
  chr4:7542297-7542404
  Hypo

SEQ ID NO: 123246 - DNA, 30 bp, Homo sapiens; identical to SEQ ID NO: 92453
  chr4:7602064-7602094
  Hypo

SEQ ID NO: 123247 - DNA, 233 bp, Homo sapiens; identical to SEQ ID NO: 40255
  chr4:7647740-7647973
  Hypo

SEQ ID NO: 123248 - DNA, 75 bp, Homo sapiens; identical to SEQ ID NO: 92458
  chr4:7679887-7679962
  Hypo

SEQ ID NO: 123249 - DNA, 413 bp, Homo sapiens; identical to SEQ ID NO: 92466
  chr4:7741281-7741694
  Hypo

SEQ ID NO: 123250 - DNA, 155 bp, Homo sapiens; identical to SEQ ID NO: 92467
  chr4:7742306-7742461
  Hypo

SEQ ID NO: 123251 - DNA, 30 bp, Homo sapiens; identical to SEQ ID NO: 92470
  chr4:7758476-7758506
  Hypo

SEQ ID NO: 123252 - DNA, 30 bp, Homo sapiens; identical to SEQ ID NO: 92481
  chr4:7941161-7941191
  Hyper

SEQ ID NO: 123253 - DNA, 75 bp, Homo sapiens; identical to SEQ ID NO: 92482
  chr4:7941713-7941788
  Hyper

SEQ ID NO: 123254 - DNA, 20 bp, Homo sapiens
  chr4:7960311-7960331
  Hypo
cctacaggccaggcacggtg

SEQ ID NO: 123255 - DNA, 143 bp, Homo sapiens; identical to SEQ ID NO: 92486
  chr4:7968382-7968525
  Hypo

SEQ ID NO: 123256 - DNA, 110 bp, Homo sapiens; identical to SEQ ID NO: 92490
  chr4:8039486-8039596
  Hypo

SEQ ID NO: 123257 - DNA, 76 bp, Homo sapiens; identical to SEQ ID NO: 92503
  chr4:8128936-8129012
  Hypo

SEQ ID NO: 123258 - DNA, 338 bp, Homo sapiens; identical to SEQ ID NO: 92510
  chr4:8201112-8201450
  Hyper

SEQ ID NO: 123259 - DNA, 183 bp, Homo sapiens; identical to SEQ ID NO: 92516
  chr4:8240141-8240324
  Hypo

SEQ ID NO: 123260 - DNA, 32 bp, Homo sapiens; identical to SEQ ID NO: 40261
  chr4:8252769-8252801
  Hypo

SEQ ID NO: 123261 - DNA, 828 bp, Homo sapiens; identical to SEQ ID NO: 92518
  chr4:8271325-8272153
  Hyper

SEQ ID NO: 123262 - DNA, 66 bp, Homo sapiens; identical to SEQ ID NO: 92520
  chr4:8293769-8293835
  Hypo

SEQ ID NO: 123263 - DNA, 105 bp, Homo sapiens; identical to SEQ ID NO: 40262
  chr4:8327019-8327124
  Hypo

SEQ ID NO: 123264 - DNA, 30 bp, Homo sapiens; identical to SEQ ID NO: 40263
  chr4:8378202-8378232
  Hypo

SEQ ID NO: 123265 - DNA, 171 bp, Homo sapiens; identical to SEQ ID NO: 92532
  chr4:8386144-8386315
  Hypo

SEQ ID NO: 123266 - DNA, 97 bp, Homo sapiens; identical to SEQ ID NO: 92536
  chr4:8483866-8483963
  Hypo

SEQ ID NO: 123267 - DNA, 113 bp, Homo sapiens; identical to SEQ ID NO: 92562
  chr4:8582115-8582228
  Hyper

SEQ ID NO: 123268 - DNA, 30 bp, Homo sapiens; identical to SEQ ID NO: 92563
  chr4:8582549-8582579
  Hyper

SEQ ID NO: 123269 - DNA, 30 bp, Homo sapiens; identical to SEQ ID NO: 92567
  chr4:8588860-8588890
  Hypo

SEQ ID NO: 123270 - DNA, 62 bp, Homo sapiens; identical to SEQ ID NO: 92568
  chr4:8594397-8594459
  Hyper

SEQ ID NO: 123271 - DNA, 30 bp, Homo sapiens; identical to SEQ ID NO: 92569
  chr4:8603223-8603253
  Hypo

SEQ ID NO: 123272 - DNA, 258 bp, Homo sapiens; identical to SEQ ID NO: 92570
  chr4:8607707-8607965
  Hypo

SEQ ID NO: 123273 - DNA, 30 bp, Homo sapiens; identical to SEQ ID NO: 92571
  chr4:8608178-8608208
  Hypo

SEQ ID NO: 123274 - DNA, 143 bp, Homo sapiens; identical to SEQ ID NO: 92572
  chr4:8608508-8608651
  Hypo

SEQ ID NO: 123275 - DNA, 106 bp, Homo sapiens; identical to SEQ ID NO: 92573
  chr4:8615814-8615920
  Hypo

SEQ ID NO: 123276 - DNA, 30 bp, Homo sapiens; identical to SEQ ID NO: 92574
  chr4:8620407-8620437
  Hypo

SEQ ID NO: 123277 - DNA, 30 bp, Homo sapiens; identical to SEQ ID NO: 92575
  chr4:8620650-8620680
  Hypo

SEQ ID NO: 123278 - DNA, 30 bp, Homo sapiens; identical to SEQ ID NO: 92576
  chr4:8647534-8647564
  Hypo

SEQ ID NO: 123279 - DNA, 30 bp, Homo sapiens; identical to SEQ ID NO: 92577
  chr4:8648137-8648167
  Hypo

SEQ ID NO: 123280 - DNA, 46 bp, Homo sapiens; identical to SEQ ID NO: 92578
  chr4:8648553-8648599
  Hypo

SEQ ID NO: 123281 - DNA, 203 bp, Homo sapiens; identical to SEQ ID NO: 92579
  chr4:8689984-8690187
  Hyper

SEQ ID NO: 123282 - DNA, 36 bp, Homo sapiens; identical to SEQ ID NO: 92582
  chr4:8700182-8700218
  Hypo

SEQ ID NO: 123283 - DNA, 36 bp, Homo sapiens; identical to SEQ ID NO: 92585
  chr4:8774988-8775024
  Hypo

SEQ ID NO: 123284 - DNA, 30 bp, Homo sapiens; identical to SEQ ID NO: 92586
  chr4:8778539-8778569
  Hypo

SEQ ID NO: 123285 - DNA, 38 bp, Homo sapiens; identical to SEQ ID NO: 92590
  chr4:8793763-8793801
  Hypo

SEQ ID NO: 123286 - DNA, 41 bp, Homo sapiens; identical to SEQ ID NO: 92593
  chr4:8822099-8822140
  Hypo

SEQ ID NO: 123287 - DNA, 1817 bp, Homo sapiens
  chr4:8858790-8860607
  Hyper
cacagcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggtcgggcggcggcggccttcccctggagtggcattcttgttgcccgtggggccccctccccaggtaggaggcaggaggcggggtctggggcagcctccgctttctccttcctccttcccccgcggcttccctgctgcgccgggcctcccaggtctcaccccgagtttccgcacccggtggggcgcgggttccggcccagcttctctcggaagtgacggctgacctagagcccatccctggcctcggcctccgcacccccccgcccccctgcctgtggaacccgcagcccagaagcctggagcctctctgcgagcacgcaggggtctcccagcttccggatcgttccgccgttcgccctgggtctgagtctgggggttcgggaaacaattttggacgtttctggttggattgtgtctaaatcgtgcattttacgcgacaggggactcgaggtccttgaggatcccaaactgccgcagcccctccctcctcctccccttgcccttgcccctgcccagagaagtgcgctcctccagggtcatccacacgcgccgtgccgagccccgggccccagttccaggagccgcgtctctacgggccagtgggtcctgagagagtagggcttcgggcgctcggggagaggaggcggaggaggggtgaagccgaggggtggcttttaacgaaaaagaagttgaagcatcagctaagccattagggctaatgcgatgtactgtaagacggggatcaatgccgggcctcggggaccggcgtgggggagggggcagcaggccgaccgcccccaagccggtcgaggcccccgtccatttgggggaaatggattttcgcgatttaagaaacaaacccaaatcaaatgagcgaggcccggatgtgctgacgctgcggttacgcgcgcggagctggagccccgagagcgctctaggaaaggcgcagcggcgaccgcgggagggggtgagaagccgaggcagagaggtccggagaagcagaaagagatgccgaccggcagagaaagagcgagacagacacaccgaggggtgagggggcaaaagggagcagcctcgcaattttcgcagaagaaaacaggccggcgcggctggggatgcgcttctgggccaggcgcggcaagaccccaggaactagccagagccccaagacccaggcgcctatttgagctcctttgagtccggcaggaggcctaggtccattcgggagagagaggtgccagcccctaccttgtgcagtcccctcgcccggacgtcatggggggagtgccccctgagcgcaggcccccgggcggccggggcctcgcttctggcggccgggagaggtcggcaccgtgacactcaggcacacatacaccaatgccccgggcccgctagggacgctgagctccaggcaacgaaaaacgaaggtcctggagtcggtcctgagtgcattcctccactgggccccgtcgagaatgaaactctcggagcatcgtcactgggaggtcctggggggacactggggtgggcgagcttcttcaaagactcggtttccactgggc

SEQ ID NO: 123288 - DNA, 32 bp, Homo sapiens; identical to SEQ ID NO: 92598
  chr4:8861124-8861156
  Hyper

SEQ ID NO: 123289 - DNA, 1568 bp, Homo sapiens
  chr4:8861410-8862978
  Hyper
tgccttctctacacacgtgcgtggtctatgtgacgtggagtcgcactgggacccgaatgaggacatccccccgccccttcgtcatcgtgggaataccgtggaacaaggcgggcaaagggctgatcagctcccgtcccggcccgaagaaagcttccaggggaggcggaagggccattcgccattccagagcaggcgcgggcagtggcccacggctctgggcccggatctgtgtccacctctggatacccaattcccgccaccatgttgttgggagcaaggaggcacaactgcccgtggtgggagtggagggcttaggtccccattagaaccggcagagccccgacggggccaacggcggtgctgacagcgcgaactgcgtcaggggcgaagccgagttcgtggagcgccgttgcgcacaagtgcgcgggtcagcagggccctggtgcctggacacccccgggtgcgcgcggcgtggctgccctggtgccccagtgagagcatgactgcgcgccaaatggaagtgggggcgccccctggcctttcctatacccggggccaaaaccgctgggaccgatatactgcaggagtccgggcacaggctgaggggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaagacgggctcagagagatgaagtgactttcccaaagccacacagcgggccagtgaaggcaccgcgcacggtccaggaatctaacccttcctggggagtggggagggaagggctcgacccgaaggggccaggcggcagagagccccgcgtcccccgccacgggctaagacgcaaggcggcccgccgtgtctccacctgcgcgcctcgagcttcgctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtccgcggggtcccggacacagcggagctggcgccactgtcggggttccgttccatctaggtcgggcagccccgcgggtccgggcgccgctgccctcctctacctgctgggaagcgcaggccgagcagggatgaacctggctccagggccccagcggggcaggcagggc

SEQ ID NO: 123290 - DNA, 613 bp, Homo sapiens
  chr4:8863322-8863935
  Hyper
gcgtaggcggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcggggcgcacctttcgcgtgggtcgggcgctgcagaccaagcacgccgagtgcgtcaaggaagtgcccggaaaccaaagacaacgcacccgggaccaagaggaggccgctgcgcgcaacctcccaaacactgcagcgaagtcggaaccacgtccgcgtgggtgactcgggctggggagccgggaggcggcgccaaggacccttcagcccttgtccgtcctccctgatatgtcctcgacgcggtctgaggcctccccagcggaggcgacgccccggcgccaggtgccctgggtgggggaacccggagggggcaccacgaccagtggagaaggggcggaggccgggaaagctgcgtggaaaagaggaagggttaagactgaaatcattctacagagaccacgttaatgggtttaa

SEQ ID NO: 123291 - DNA, 594 bp, Homo sapiens
  chr4:8864526-8865120
  Hyper
cgtttgctccccaggcggtgaggctggctcttcgaccacttagctgttctcggcgcccgatcctgtgtgtccttccgtgcatgacacgcagagcttagctctgtgaggacagggctgtcccctctccggcccacctatgaaggggtgtccacctctccgtttccctccagggcagtcattcattgggtgatccgccttggggacctggggatcggcgagtccaggaggcccagcgaacgaatttccggtggctgggacccacttcccagcgggaccctggataggcatgcccactctggctaccagaagggcagggtggccgaagggtatgaagcatatgagtgcacaggcggggaggaacagcagcagcaccagcgcaggagtagcccgctggcctccctcaggcgggtggaggagggcgccggggagcctcagtgccaccgtgctccagaattcctgcccctctcagaaccccggtttccctttccaacaagttgcaaggtggggcggaaggccacgaaagactcttgggggagaggcactgacagaaagggaaagagaagcccacccggcctctcccgcctccctggtgct

SEQ ID NO: 123292 - DNA, 30 bp, Homo sapiens; identical to SEQ ID NO: 92606
  chr4:8865644-8865674
  Hyper

SEQ ID NO: 123293 - DNA, 1456 bp, Homo sapiens
  chr4:8868700-8870156
  Hyper
tgctcccaggagggacggcacccagcgcagcttgagctgtctctgccctcgtgatcacaaagcagtgaaactgtccagaaaatgtccctttttattccatacgcaaataagtagattcatttaaaaaaacaacaacccggaggctgcgacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgag

SEQ ID NO: 123294 - DNA, 1306 bp, Homo sapiens
  chr4:8872678-8873984
  Hyper
cagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgggcagccgcctggctcgcctttcaggtcgccgttctggtcgccgccggggcggcctcactgggggcggggagggggaggggccagcaggggcggggggtcgcgggctgggccgggagggcggcccgctgagccccgaggacgctgcgccggccccgagcgcggccgctgccgggagacgctgcccagacctgagcgcgcgggcagcggcgcagccgagggcgggcggccccgggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgt

SEQ ID NO: 123295 - DNA, 252 bp, Homo sapiens
  chr4:8874476-8874728
  Hyper
ctcccatatctgcagcgggaagttcgggaacataacgcaccctggagctgtctccgttccggcgtcgacttcagacttacctacattaggtcactgcgcggacgcgcgggttaagccggcttcacccgatgcgagttatttcgcagagatacatccatcctcccagggccagccccgggcccctctccacccgagtaccgcccgcgttcccggaggtgaccgcaggcctggggcttccgctttgtttaattc

SEQ ID NO: 123296 - DNA, 233 bp, Homo sapiens; identical to SEQ ID NO: 92613
  chr4:8875695-8875928
  Hyper

SEQ ID NO: 123297 - DNA, 139 bp, Homo sapiens; identical to SEQ ID NO: 92614
  chr4:8878536-8878675
  Hyper

SEQ ID NO: 123298 - DNA, 171 bp, Homo sapiens
  chr4:8879491-8879662
  Hyper
cctggagcctggaaccgccggggccagctgagaagccgcctccgccgctggagtccctgggaagggtcccctccacctgcccacagccagcctgggaggcagacgcgccaacgtctggcccctcagcagggacagcggctccaacaaagccacccccgggaggggacgctg

SEQ ID NO: 123299 - DNA, 680 bp, Homo sapiens
  chr4:8893356-8894036
  Hyper
tttgcttcactgcttcgcccaaaaccgagaacccgcggctcacagacgctccatcctatccgcggacagaaacgaatccgagccgcagctgcacgtttgaaccccgcaaagccactgtgagccggtactgaaaccccaaggaaaagtcggggtttgggggcgggatccttgccccatgtgggttgggaaaagacggtgggaaccttcgggactctggagtggtgaaatgacgggagaggacactcaacactcccgactcatgcccttcagagcggagctctgacctggcctcctccaggcagtcttcccggctgcgtcctgccctatctcctcctccccagctcggcgtttgcagccccgctgggccgcgcgcaactggagcgccaagttgcgtcacctgagcgctgttaccgtggtgcccggtctgaccgcgtgtgcgaacccaggcgtctgcgaccgcgaagctgcgagttgtctcgggccctcccggagctgcgggcggctcctcgagaaactcagagagcccaggcgcaccacgggccagccaggacatccccaggcggccctgttagccccattttatggaggaagactgaggctttgggttgcatgggacccgcggttaccccgcaaacacagacgcttacgaagacgctatcgcgagccgaacagtctggagg

SEQ ID NO: 123300 - DNA, 1723 bp, Homo sapiens
  chr4:8894641-8896364
  Hyper
ggaaacgcctgcctccggtcggtctagcgcggcgtgtgcgagtgcagcccccgcggggacgtgggcaccaacagcaggcgagtgactaccgcggcgcagttcccgaggacccagcgcctctcccgaggccaccctcccgggcaggaattactgtctgccggcccgaagccgccaccccacccgccgccctgtttcaaagttggggagagtccatgccgcgacggagcgagcagacttggacatggtcgagtgcctggtgcgcacgattggtcttaagagtttagggaaaaaagcacgcggggaaaccacgcggggcccggcgcgctctcgtttcccaccactgcccccttcccgggcaccgtgggccgccgctgttgcccgtcccgctttcttctcgcctcggagcaccgggtcccccggagtgacctactgcagccgagccccggcggtcgggggcttgcgctgggttttgggacgcggtctcagacgcttggccctgtggccctacccatcggttccggtcccaagaacggtgctctcctgtgcctcgggcctttcccggggcgccgggccgcggcaggagcgacctccgcccgcgctaccttcctgccctgtggcctacctgggtcccccttacacctctgctcggtgcagccctgagcctcggtttcccagacggcgcagctgaggctctcgaggtgacgagaggctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctggcaggcagacacgctgcgccactggggacaatgcgaccccaatgagctggcgctcccctctggcgaaggaccaggtggcgaggtcgcccctgtcgtgtggcccaatgcgttaccagcaagaacaaagtcccatcttaactgctcttcgcgcggcttttgaccttgggtcggggctgcgtctcagcgctcaacagccccgcttctccccacggttttaaattaccggaacgaagccactgccagcggcgcctgcacggggagggcagggagcgctcggggcgcattgggacctcgagtaccttcaccctagggagtgctcgtccccagcccggcctctgcggccgcccccggcccagcccgtgctgtcctcatcttatcgcggcccgccccggccctgcgctcccgccgctccgcagccaggtttctccgctgccgtcctcttccagggccaaggggccgtggcagacccggagcctcccggaggcgcttctgccggggcggattatctcccctctcccaccaggccccggcggggggcaccaactcgccccgaaagccgagaagcgctggaactccccctcctggccccctcctccgcttctgtttgtttaaccttccggcagggcggtgaccctgcgccctgccaggcgctgccatggggtcaggcgggggtggggggcgcctcaggggtccggcggcggctgggagtcccccgagcagcagagaccctcctcctgtctcctgttctgcccatcgtgggaagtgtcccaggcctggttgtgccagaggccctgggcgaccttcagcagtg

SEQ ID NO: 123301 - DNA, 54 bp, Homo sapiens; identical to SEQ ID NO: 92625
  chr4:8911942-8911996
  Hypo

SEQ ID NO: 123302 - DNA, 52 bp, Homo sapiens; identical to SEQ ID NO: 92629
  chr4:8965616-8965668
  Hyper

SEQ ID NO: 123303 - DNA, 124 bp, Homo sapiens; identical to SEQ ID NO: 40270
  chr4:8967222-8967346
  Hypo

SEQ ID NO: 123304 - DNA, 30 bp, Homo sapiens; identical to SEQ ID NO: 92640
  chr4:9153953-9153983
  Hyper

SEQ ID NO: 123305 - DNA, 83 bp, Homo sapiens; identical to SEQ ID NO: 92646
  chr4:9423198-9423281
  Hypo

SEQ ID NO: 123306 - DNA, 169 bp, Homo sapiens; identical to SEQ ID NO: 92654
  chr4:9499324-9499493
  Hyper

SEQ ID NO: 123307 - DNA, 172 bp, Homo sapiens; identical to SEQ ID NO: 92655
  chr4:9499862-9500034
  Hyper

SEQ ID NO: 123308 - DNA, 682 bp, Homo sapiens
  chr4:9783020-9783702
  Hyper
aaggctccagggatgcgccaagcacccttcggttttcccggggagaattttccccggcccggggactagggtctggcgctggggcgcccctcggacctgcgggatcgcccctacactctggcgcgctgagggcggtgagcgagggcgccaaggcacaggtggggcgggagtcgagcgcggaggctcggggggcgggacgcggggcctgggagcggccagggaccgcggcagcgcctcagtgccagcctggcgcccgcgactgcctgccccagcccctcagtggcggcttgctctcttctctcgctccgaaccagacacagccgctgccgctgccgtccggcgcgctacagactcccgagaacagccctggctgtcagcgagcaccagccgcttcctgtccccatcgcggagactggaggggcgcaccacggccatggagccagaggcgcttcaggaggcaagagaagtccccgcgcgctccgcagcccggcgcagctcatggtgagcgccctctggggctcgagggtcccttggctgagggggcgcatcctcggggtgcccgatggggctgcctgggggtcgcagggctgaagttgggaccgcgcacagaccgcccctgcagtccagcccgaaatgctgccgccaggcagcaacggcaccgcgtacccggggcagttcgctc

SEQ ID NO: 123309 - DNA, 176 bp, Homo sapiens; identical to SEQ ID NO: 92680
  chr4:9847574-9847750
  Hypo

SEQ ID NO: 123310 - DNA, 30 bp, Homo sapiens; identical to SEQ ID NO: 40271
  chr4:10200240-10200270
  Hypo

SEQ ID NO: 123311 - DNA, 30 bp, Homo sapiens; identical to SEQ ID NO: 91413
  chr4:10319571-10319601
  Hypo

SEQ ID NO: 123312 - DNA, 30 bp, Homo sapiens; identical to SEQ ID NO: 91423
  chr4:10412582-10412612
  Hypo

SEQ ID NO: 123313 - DNA, 955 bp, Homo sapiens; identical to SEQ ID NO: 91424
  chr4:10458372-10459327
  Hyper

SEQ ID NO: 123314 - DNA, 762 bp, Homo sapiens
  chr4:10462775-10463537
  Hyper
tgccagtctctgagacgttttctcaactgcaaaacaggagtaactggagcaacctttcgtggagggtgccaggcgctggagcgtggctaaggcagggaccacgtcccagccgccctttcccgccctgcggcgcaggcccactctcttggctctcctggcccgcacactcagctcggccgccgcggctgccgcggaagcgcgcagtgaggctagtggggccacgagcggcgcgctgagcatgcgcgcccgatagagcctcgagatgcgccgggccgcgctgcgctgcagtaccgcccgcggcctgcagtgtcgctgcgagcccggctggcccagctcggcgtgtagagctctaccccgcgcggcgggcggtgcagccccgcgctcacctgggcgtcttcgctcccgctcgccccgcgcttccgaaaatcgggaatgtaatgttttgtttttacattccaatttgctccctccccaggctggcgtggaatccgagggttcctgatgactgcagctcctcgcccctcccgctgtgttcccgccgcctctgggctgaaagcgccatcaggacccgtggcgcgtgggctttgttaagtcattaactgcttgggacatagcaggagcatggtgcgcggcacagaacaggcttggcttccacggcccatccaggcggagccgtcagcgtcccttgcctagaccagagctctggaaagcggagaggcggacaggggccgttccccagatctgttccggaggatgcagatc

SEQ ID NO: 123315 - DNA, 35 bp, Homo sapiens; identical to SEQ ID NO: 91428
  chr4:10501134-10501169
  Hypo

SEQ ID NO: 123316 - DNA, 30 bp, Homo sapiens; identical to SEQ ID NO: 91519
  chr4:11428999-11429029
  Hyper

SEQ ID NO: 123317 - DNA, 145 bp, Homo sapiens; identical to SEQ ID NO: 91520
  chr4:11429558-11429703
  Hyper

SEQ ID NO: 123318 - DNA, 48 bp, Homo sapiens; identical to SEQ ID NO: 91521
  chr4:11430659-11430707
  Hyper

SEQ ID NO: 123319 - DNA, 30 bp, Homo sapiens; identical to SEQ ID NO: 91530
  chr4:11781107-11781137
  Hypo

SEQ ID NO: 123320 - DNA, 827 bp, Homo sapiens
  chr4:13523948-13524775
  Hyper
tccctaccttcctcccgagggagaggcagagcctctagctccatttcagacctgcaaggaaagggctttgagaagggaactggggagaagcacgttccaggtgtgggttcagctcggcactcgccacaggcctccgcaggtggctctccttggcagcgaggcaaggcgcaaacccgctggcttgggaagcctgacgtgacccccgcccgccaagcctggcaggaagcgacgccggggttctccgcaagaagaaggcggcctccgggtgtcggccgcagccaggctactgtgctccggggcaaaccgctgcaaagtcctagtgaggcagaactcgacccccaacactcagcagcctgccgtccacccatccacacccccgtctcgccccctgccccaagctggcagatgccttgtcgcccctctaagaccgcacccggattgggtggctgcaaagacgctcgccaaagcgctcagagccccagggaagccgtggcgcctggcagctccctctcctctgggagatctgggggcgccagggctgccggggcctagcacagcgtgcgccacgaggcttaaggatgcgaaaactactgggaggccgagagaggtcccgggagcaggggcttgaggaggcaccttggggctacggacttcgctgccgtggtggcctcgcaggagaaagtggcttaaatgaagagtcctggctccaggcttgacgcccagctagataaacgatcacctccctgagaggaggccttgggcatgccgtgttcccagagcccatggcacagtggcccccagaacacgctgatcgagcagaggccaga

SEQ ID NO: 123321 - DNA, 333 bp, Homo sapiens
  chr4:13525379-13525712
  Hyper
acactggcctggctgcgctgtactgccaggtggccttctcaggatccctcgctgcgcctctcagccccatcccatccaaaccacgccccgcctgcggccactagcccattttatcccattgagcccccgtccttccccatcgcggggttccactccactggtgccagggctatgcccctcacccacccactccaccggtgctggctaccgcaatctctacccgggcgtccagattcctggccttgtcctttctgctggaatcatcaatgggatcgcgccgccgccgccgagcagccctacactcctggctcgcgctctcggcctccggcacct

SEQ ID NO: 123322 - DNA, 259 bp, Homo sapiens
  chr4:13526706-13526965
  Hyper
agtgaggtccgcactcggcgcagactgaagtgctccagaactaaccacctccgcagacgcaacggagccaggaggggcctcaggggcctccaaccgcatggctcttcccagctttcccggacaccagcgctgagcactggggagccggggagcaagcgccaagaggagcttttaaattaaaatttccagagtagcctcagagagggagggaaattccagttgaaaagccccttctgcctcaggacgttattcagtaaaa

SEQ ID NO: 123323 - DNA, 58 bp, Homo sapiens; identical to SEQ ID NO: 91613
  chr4:13529323-13529381
  Hyper

SEQ ID NO: 123324 - DNA, 37 bp, Homo sapiens; identical to SEQ ID NO: 28814
  chr4:13529606-13529643
  Hyper

SEQ ID NO: 123325 - DNA, 254 bp, Homo sapiens; identical to SEQ ID NO: 91615
  chr4:13530726-13530980
  Hyper

SEQ ID NO: 123326 - DNA, 99 bp, Homo sapiens; identical to SEQ ID NO: 91616
  chr4:13532820-13532919
  Hyper

SEQ ID NO: 123327 - DNA, 41 bp, Homo sapiens; identical to SEQ ID NO: 91617
  chr4:13536477-13536518
  Hyper

SEQ ID NO: 123328 - DNA, 204 bp, Homo sapiens; identical to SEQ ID NO: 91618
  chr4:13537569-13537773
  Hyper

SEQ ID NO: 123329 - DNA, 30 bp, Homo sapiens; identical to SEQ ID NO: 91619
  chr4:13537979-13538009
  Hyper

SEQ ID NO: 123330 - DNA, 30 bp, Homo sapiens; identical to SEQ ID NO: 28817
  chr4:13539344-13539374
  Hyper

SEQ ID NO: 123331 - DNA, 180 bp, Homo sapiens
  chr4:13540888-13541068
  Hyper
aagggaaggggcgcccgggtccgcagggtaggtggagtctgcggtggaagatggagccgccaggggtgcgaccgggacctctgtggcttttcctactctaaagaaactcccggattctttcaccgcccaatcggcaaagatggagaacaaactaccctcttaagacgcagcaacaagcaa

SEQ ID NO: 123332 - DNA, 39 bp, Homo sapiens
  chr4:13541408-13541447
  Hyper
aaacgctggtcaccacgctccgcccgggccagatccgag

SEQ ID NO: 123333 - DNA, 173 bp, Homo sapiens; identical to SEQ ID NO: 91623
  chr4:13541822-13541995
  Hyper

SEQ ID NO: 123334 - DNA, 823 bp, Homo sapiens
  chr4:13543579-13544402
  Hyper
agcgcgggaatcactcgctgcctcagcccaagcgggttcactgggtgcctgcggcagctgcgcaggtggagagcgcccagcctgggaggcagtagtacgggtaatagtaggagggctgcagtggcagaagcgagggtggccgcagcacttcgccgggcaggtattgtctctggtcgtcgcgcaccagcacctttacggccaccttcttggcggcgggcgccgaggccagcaggtcggctgccatctgccggcgctttgtcttgtagcgacggttctggaaccagattttcacctgcgtctcggtgagcttcagcgacgcggccaggtctgcgcgctcgggcccggacaggtagcgctggtggttaaagcggcgctccagctcgaagacctgcgcgtgggagaaagcggcccgcgagcgcttcttgcgtggcttgggcgccgccggctcctcctcctcctccgcgacgcctgccggcccgctgccgcccccgccgccggccccgctgcacagcgcggacacgtgtgcacctctggggccaacaccgtcgtcctcggtccttgggctgcggtcgcctgcggaccccggtgggaacagaaacaagagactgtcagcgccacagacgaggtgaggccgggcctcaactgcaggggtcacgggagtggggcggaaatacactttgatcccactcaagcggagcggaggtctgggaggccctgggcccgggagaccagtcttagactcttgccccactgggtatcccatctaggcctcttctggggagggcggcagactcagccgctgtgtcaacgctgtgttgtcgag

SEQ ID NO: 123335 - DNA, 1294 bp, Homo sapiens
  chr4:13545462-13546756
  Hyper
ctccgagccccagggcgcagggtgctcaagccgaccaccccactcggcgtggttgccctccgcgtccatcccctcagcccggcccccatccccgcgaagccgcagcagacctgagacgctggcggacatctcgctgtcgctccggcccgcggcttcctcctctaggtctttggaagcggccagctcacagaccggctggccgaggctcaaggatccccccgcaaggccggccccgctggccccccgcgcgtccgcgcagcgccgcctgctctcgttctcctcgctgagcgcggagtccgagtcccagccttccgggctctccgcagtccgccccgcagctgttctggtaccggcaggagacgccagcagagagtcctcggcgccccccaacgcgcccgcgtccctctccccaaagagccgccaacagcagacagcgggagccgcggccaccgatgccgctgtgcccccgggcgccgggcgcccctctggcgcggccagcccgccgcgctcctctttcttgttgaggatcgcctggatggagaaggacgtcaaggtgttggcgccgcgcacagccatctgcgccgcgggcaggagcggccggcggggcgggcagctggggcgccgagcagctccgagcgggacagagagcgccggcggccgcagcgcgagtgagctgggtgtgcgaggccgccgccgcccactgctgcgcggcccagcagctcccgccccactccgtcccaggatcagcgccgaccctcgcccccaccttagaggcccaccccgcccggagaccccctccccccgaatccagagccagacgctctcctttcgcagctcagctggattatctcatcgcttctcgcccttaggggcgggctggggtctgccccctcgggggacgtgaaggaggattggcgggggcccctccgtggcagcagtcccctcccgagcgccgccggggcgcacagcccgagtcactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaacttttttaccccctgccctggttttatctgtttcttttctctttccttcccttgcgttccactgtaccacccccctcccgcccgggtgtcattcctcactgctgagtgacagcctgaggccacacccctccactgggctgtcccgggcgctcccggccgtcc

SEQ ID NO: 123336 - DNA, 1362 bp, Homo sapiens
  chr4:13548502-13549864
  Hyper
aaagatgtggtttggcgactttgagttgtcgggtatttttgtgtcccaggagtgtgagaaaggggctacgttccgcgtcttccggaggcgcacagcaagggagtctcctggtgtcatctcgggccattacggcgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcgggcggcgggcggagagcgggatttgactgcgaaagccaagggggcggggaaggggaagccccggccctcgggggcgcgcagtaaactgctgcacacgtgcccgcgctcccgaggggggcgcccagtgggctcgggatttcctggctgcgccaccgcgcgcctcgcccccgacgcccgccacctgtgccctgggccgccttccctgacgccagcggccggaggtcgcgcgcgccgggtgctgcccagcaacgaaaggccatgcggggttcgtccctcagatgccggtgaccttgattgaagtcacctgccttctctagcttccagtcctttaaaacgagggtttggacccggtgccttctgaacccggtgcttcactgagtgagcaagtgaagggtgtgtgtgtgtgtttggggtgggggcgggggcgaggggagggaggggcagcgttgccggctccccagagccaggtccaggcagaggtcgcgcccagcactgaccgtcggtcccaatccgcagactcccgagg

SEQ ID NO: 123337 - DNA, 188 bp, Homo sapiens; identical to SEQ ID NO: 91728
  chr4:15412373-15412561
  Hyper

SEQ ID NO: 123338 - DNA, 28 bp, Homo sapiens
  chr4:15697095-15697123
  Hypo
acaaggtgaaattgacgggaaaaggaag

SEQ ID NO: 123339 - DNA, 709 bp, Homo sapiens; identical to SEQ ID NO: 91787
  chr4:15780033-15780742
  Hyper

SEQ ID NO: 123340 - DNA, 33 bp, Homo sapiens; identical to SEQ ID NO: 40273
  chr4:15789491-15789524
  Hypo

SEQ ID NO: 123341 - DNA, 199 bp, Homo sapiens; identical to SEQ ID NO: 91802
  chr4:15826894-15827093
  Hypo

SEQ ID NO: 123342 - DNA, 553 bp, Homo sapiens; identical to SEQ ID NO: 91809
  chr4:16083930-16084483
  Hyper

SEQ ID NO: 123343 - DNA, 1009 bp, Homo sapiens
  chr4:16084707-16085716
  Hyper
ccatatccctactcccgctgtggtcggctgcacagtgttggcccatttccgcactcagccagggaagctcagcgcctcacgtccccggggccatccctagagtttcctttaccgcagactcgttcccaagaccctggcgagtctcacctcggtcaccgttctccccgagagcgagtccgaagtctctggggccccggtccagttcgcacactcacctccgactcccgctccggaaccacggccgccggctacccccacccccgcccccatccccagtggatggaaagaagacccaagcggggcgtcgcgggccaccactcagactaaaaagtttgggttggacgggcaccggcaccaccacgctctccccgcagttcctctggcccccagccgctgtccgggcccgcaccacctgctgaggggccagggaggcggcgcagatggctagggtaaggggggcgcagagcgaacccgtccactcctcactgtacacccccagtacagtggaaggagtgcgctcagccccgcgcctggtcagcagatgcctctctcgctccgggatgaggacccagctactcaccgtgcacccggctcccgctcctgctcccgccctagtcaccgctgccgccgcccttcccttagctcgccagaccctggctcgtgaattatttatgacccggcttctgggaccaccgcgacggctttcggagagcccgcctcccactgccggccgcggaggggctcaggcggcgctgcggccggaccctcggacgtggcgggaggcaggagaaaggcccgggtgcccggggggacccgttgcggcttcctctgtcccggacggggacctaggtatggggccgccgtaatggaaaggattccttaaacatactcaccgcggcgggagagctgagagcatggccaggtgccgcgtggggatctgcctcagtcacttaaagatcgcgaaacccgagccctggacgcactctgattggaccggctgagctgcttc

SEQ ID NO: 123344 - DNA, 106 bp, Homo sapiens; identical to SEQ ID NO: 91840
  chr4:16787092-16787198
  Hypo

SEQ ID NO: 123345 - DNA, 30 bp, Homo sapiens; identical to SEQ ID NO: 28831
  chr4:17326218-17326248
  Hyper

SEQ ID NO: 123346 - DNA, 30 bp, Homo sapiens; identical to SEQ ID NO: 91902
  chr4:17638206-17638236
  Hypo

SEQ ID NO: 123347 - DNA, 779 bp, Homo sapiens
  chr4:17782834-17783613
  Hyper
agtccattctccagccggcgccaccgtcggctttggagccctggcaagtgccgggcgggttaattttgctgttgagagcagaagccatcgctaaaacgcgcccagcactcagactctctcgttttctccctgcccaccgtgtgcacgtgcgtgcgcgcgcgggcgtgcgagcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgcggtgggcgggcactgcgctcttggacacgtgggtggcgcgcggccctggacttggtggcgacggaccctgcccgaggtggggatcccaggctaaagaggaagaagagcctccggagagggacagggcacagtgactggcggcctccggagagggacagggcacagtgactggcggctcccgagtctccgagctgatagcggagatggcggtgggggacgagatgctaagagaggggcgggtaggtgagggcgagccatcgggactcaaggaggtgtgggatccggggcgcacggtgtgggccagcgcctgagttgcgcg

SEQ ID NO: 123348 - DNA, 30 bp, Homo sapiens; identical to SEQ ID NO: 91919
  chr4:17818237-17818267
  Hypo

SEQ ID NO: 123349 - DNA, 466 bp, Homo sapiens; identical to SEQ ID NO: 92009
  chr4:20253509-20253975
  Hyper

SEQ ID NO: 123350 - DNA, 106 bp, Homo sapiens
  chr4:20254217-20254323
  Hyper
tggctctgcgccctccggaacccggctcttgtttcttctacctttgccatcaggtgtctgccgcggagctgcggcttatctgggagacgagcggggttgacacgcg

SEQ ID NO: 123351 - DNA, 427 bp, Homo sapiens
  chr4:20254693-20255120
  Hyper
ccagacatccttcagcgaagtgcatgtgtgtttgtaaaccatcgttggctgtcgggagaccgcgaggaccggtccaggctgcggcggagtcgagggcgagggagaggccgcgtgagtgagcagagtccagagccgtgcgcccccagaactgcgcgtccgccccgtgcacccccgcgcgccatgcccagttgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatcct

SEQ ID NO: 123352 - DNA, 1603 bp, Homo sapiens
  chr4:20255327-20256930
  Hyper
ctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcagcgggcgactgcgagggaggaccgtgtcccatccgttaagcgaagttagcactggttctccagcgcaaaccagcccaaccaggtcttaccactgcggcgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctaggcacgttccgctctcgcggttgcgtgtgggccgggagtaagcgaagggcgcggggctaggccggcaggggccagcgcgtctggattcgtcccgcggcctctttgcccccggggtgtaagggtttcgggccgtggagaggaggcgctctgacccgcacgtctccacccgcgcagcccattgcacttcaagtcgcccttcttatccaacccatttctctcgcccttagttttaa

SEQ ID NO: 123353 - DNA, 270 bp, Homo sapiens
  chr4:21305925-21306195
  Hyper
agccacgcatgaagtcgcggcgcagatcacccgaggacccaggaggtcaccaggaacgtcccgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggag

SEQ ID NO: 123354 - DNA, 1001 bp, Homo sapiens
  chr4:21949877-21950878
  Hyper
atgcataaacaacctcggaaattttcagagaaggcaaaagtacgcacaggatcgcaggggaccctgccaccggcgagtttcaaacacacttcaaacatcttttcttccccgacctggatcttgcatgcacccccctctcctttgcaccccattcctgccgctcccacctccccttcccagtcccgccaggtgactgtgtctcatgcagcgaaggcaacaagcgtccccagccgaggaagggaaggggcagccgtcttggctcgcgagggaaggagggcggaagcgggcgcccgctcgcaagcttattgcatcctaccgcctgtagagctggcctcctccagctgagccgaaatgctttccaccctcctcacattcatgtctagggacgcagggtgcagaagcgagactcgagagtccaccggccaggggcgtctgtccacgggtctgcacgggagcgcaccgccgctcggcccgggggcgtccgtggcgctgggagcgagagcttcggcggcggctgcgggcagggcgcgcggagcgggctgcaggtgcgggcggaggccggcggggggcgccgggggcgctgcgcggcccttggcggcgggggcgcgcggggtggcgggggaggccgaggcgccggcagcttcgcgccggcggctggaagcgggcgggctgcacgggcggctcgagtgcggggaccccagcccctcgccctcgtgagcgccgcccctgccacctgctgccaagtcaccggactggggatgcggggggcggggtgcggggagaggaaagcgccgcgggtggcacggtgcctctggcgacagagtagatggacccgaaagagacccgaggtgacttcgggctgggcaggacacccccgggagttgccagcggctctcagcgggcgcctctaggaccccttgtcactgcgagcagcgcctgctctggggaggggctcgaaggcgccgcgccttctcaacgcgccgctgcgtcccccaggggct

SEQ ID NO: 123355 - DNA, 30 bp, Homo sapiens; identical to SEQ ID NO: 92034
  chr4:22516841-22516871
  Hyper

SEQ ID NO: 123356 - DNA, 30 bp, Homo sapiens; identical to SEQ ID NO: 92035
  chr4:22622408-22622438
  Hypo

SEQ ID NO: 123357 - DNA, 146 bp, Homo sapiens; identical to SEQ ID NO: 92042
  chr4:24471691-24471837
  Hyper

SEQ ID NO: 123358 - DNA, 209 bp, Homo sapiens; identical to SEQ ID NO: 92043
  chr4:24472371-24472580
  Hyper

SEQ ID NO: 123359 - DNA, 407 bp, Homo sapiens; identical to SEQ ID NO: 92044
  chr4:24473331-24473738
  Hyper

SEQ ID NO: 123360 - DNA, 30 bp, Homo sapiens; identical to SEQ ID NO: 40275
  chr4:24535112-24535142
  Hypo

SEQ ID NO: 123361 - DNA, 308 bp, Homo sapiens
  chr4:24801697-24802005
  Hyper
cgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccctccactctgaggtctcaccttcgcctttgctgaagtctccccgcagccctctccac

SEQ ID NO: 123362 - DNA, 398 bp, Homo sapiens; identical to SEQ ID NO: 92049
  chr4:24914406-24914804
  Hyper

SEQ ID NO: 123363 - DNA, 50 bp, Homo sapiens; identical to SEQ ID NO: 92050
  chr4:24967393-24967443
  Hypo

SEQ ID NO: 123364 - DNA, 89 bp, Homo sapiens; identical to SEQ ID NO: 92051
  chr4:25013961-25014050
  Hypo

SEQ ID NO: 123365 - DNA, 59 bp, Homo sapiens; identical to SEQ ID NO: 92052
  chr4:25032044-25032103
  Hyper

SEQ ID NO: 123366 - DNA, 38 bp, Homo sapiens; identical to SEQ ID NO: 92053
  chr4:25090356-25090394
  Hyper

SEQ ID NO: 123367 - DNA, 69 bp, Homo sapiens; identical to SEQ ID NO: 92054
  chr4:25098014-25098083
  Hypo

SEQ ID NO: 123368 - DNA, 35 bp, Homo sapiens; identical to SEQ ID NO: 92058
  chr4:25377692-25377727
  Hypo

SEQ ID NO: 123369 - DNA, 128 bp, Homo sapiens; identical to SEQ ID NO: 92060
  chr4:25656679-25656807
  Hyper

SEQ ID NO: 123370 - DNA, 363 bp, Homo sapiens
  chr4:25657130-25657493
  Hyper
cacttgcgggaatctcgtgcggaccgagtcggggcgggagagggcgcgcaccagccaggctagggcgcgcggggcgccgaggggcgcggggccgtttggggccgttcgggccagttcgcgcggcggggcccgtcggagcttttctctcggcagcctggctggccgcgcgtcttctccgcgcagcgggcgaagtcgcgatgggttcattaaggcggcaggtaggcagtgccccggcggcggctgcggcaggcggtcctggaatgtgcgaggggcgtgatgacagcggccagcctctttgcgcaacaccttcgccatatatacccggggcgctgcgctccacctggccgccgcctccagcccagc

SEQ ID NO: 123371 - DNA, 261 bp, Homo sapiens
  chr4:26030405-26030666
  Hyper
gcctgggtgattttacgtgcggatgcagaggaggggcagcgtcggggcggcggagtccgacctcgggggattcaccctgagggttacaggcaaggccgctccaggcacgcagcacctgccgggcgccacccaggagggggcagcagcgccattcgcaaagccggcccgctccgctccgctctcaggctcagggctgcggagacaggaatcgcagcttcccctggaaggggcgtcccaggggacctccgccaggccagggga

SEQ ID NO: 123372 - DNA, 30 bp, Homo sapiens; identical to SEQ ID NO: 92067
  chr4:26296591-26296621
  Hypo

SEQ ID NO: 123373 - DNA, 52 bp, Homo sapiens; identical to SEQ ID NO: 92069
  chr4:27086432-27086484
  Hyper

SEQ ID NO: 123374 - DNA, 90 bp, Homo sapiens; identical to SEQ ID NO: 92070
  chr4:27086750-27086840
  Hyper

SEQ ID NO: 123375 - DNA, 30 bp, Homo sapiens; identical to SEQ ID NO: 92080
  chr4:30718156-30718186
  Hyper

SEQ ID NO: 123376 - DNA, 30 bp, Homo sapiens; identical to SEQ ID NO: 92081
  chr4:30718953-30718983
  Hyper

SEQ ID NO: 123377 - DNA, 250 bp, Homo sapiens; identical to SEQ ID NO: 28855
  chr4:30719374-30719624
  Hyper

SEQ ID NO: 123378 - DNA, 571 bp, Homo sapiens
  chr4:30719850-30720421
  Hyper
tccctgccctggcctcggaggaggagccaccacccctggggtgatgctactttcacagactggaaaatactcgccagctccctgacacacacttagacacacttccatccaacgggcatctacgatcccctgtagggagagcttggaaatctctgccgcctctccctcctcattcctgttcctgcgcccgcccaaacaaccgcgcgctacatctgctcgttgactttattggtgtttgtcttgtttaaatcattctgcctcgtcacccaggtctcgtaaagaatacccacactggacagattttattttttcggctttaaatttttctttgaggggaggcccttaaatgtgtatggatacgtcaggcgagctgaagactaagcaaatcccagcagcggccctttctctctttcgagatggtaaaaattctccccaaatacctacagtccgtctcagtcgtcttaatcctagccgggcctcttcgtttacagccactgaaataaatgagtaaatggctcagttcaaaaacacaaccagacctgagatctgatgaggccggctgcggtggtcg

SEQ ID NO: 123379 - DNA, 303 bp, Homo sapiens; identical to SEQ ID NO: 92085
  chr4:30720644-30720947
  Hyper

SEQ ID NO: 123380 - DNA, 223 bp, Homo sapiens; identical to SEQ ID NO: 92086
  chr4:30721247-30721470
  Hyper

SEQ ID NO: 123381 - DNA, 30 bp, Homo sapiens; identical to SEQ ID NO: 92087
  chr4:30721945-30721975
  Hyper

SEQ ID NO: 123382 - DNA, 172 bp, Homo sapiens; identical to SEQ ID NO: 92088
  chr4:30722839-30723011
  Hyper

SEQ ID NO: 123383 - DNA, 437 bp, Homo sapiens
  chr4:30724216-30724653
  Hyper
gcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggcc

SEQ ID NO: 123384 - DNA, 155 bp, Homo sapiens; identical to SEQ ID NO: 92115
  chr4:35962570-35962725
  Hypo

SEQ ID NO: 123385 - DNA, 30 bp, Homo sapiens; identical to SEQ ID NO: 92119
  chr4:36206328-36206358
  Hypo

SEQ ID NO: 123386 - DNA, 18 bp, Homo sapiens
  chr4:36311031-36311049
  Hypo
gatcgcaggttgcagtga

SEQ ID NO: 123387 - DNA, 30 bp, Homo sapiens; identical to SEQ ID NO: 92121
  chr4:36345308-36345338
  Hypo

SEQ ID NO: 123388 - DNA, 207 bp, Homo sapiens; identical to SEQ ID NO: 92122
  chr4:36418721-36418928
  Hypo

SEQ ID NO: 123389 - DNA, 1904 bp, Homo sapiens
  chr4:37245537-37247441
  Hyper
gaacccacaccctcccgcccggcccaggtgcgcacccggccgcgcggggctccagcaacctggcggccgacgggcccgggagctgtcaggcgagcagaacagccggtgagtgcgccttgatgggagcagaaaggcccctaggaaccttggaggcctcggaggaactacccgcggagatccgctcccagaaaggttccgggaccacgcggcgaggagcacgtgaacggcgcagcttggctataaaaaccccgctcaagcgcgcgtggggagcaaccggagcggcaggacgctgccacctgcgccaggagagatagggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggagtccaggaggctcctgcgcacccccgaggcccccgcgcccaagccccggccgtcctctaagccgcaagttatttctgcgcccgagagaggcgggctcggataaagtcgggacgccttctggtacataaagtttcatctgctctcctcgctcgcacggtccctgccgcctggcggccccctcctcccacggcgggcgcgggcggggagatggccgccggcgcttcccggcgcaaacgggcgctgcgcgcgtagccgccgccacgctgacctcccgctccagctggctgctgctcggagccctagcagcgggcgaaggcggaggcccagaagggcaggagaccgccgcgacaggagcccgagggtccgtatggcttctcctcgccggcgggtgctgtgcgccacggagctcgccaaaggcgcttcgggctcggagcggctctgagccgcgccgcctgctgagatcgaccgcctgctgagccgttccgtggagctgcgggcaggaacccgaggagcaggaggtggcggcggcggcagtggctgttcctcccagagggcgatgtggccggccggcgcgggcaccaagctgccctgtccccgagactctgcgctccggcgggcggctttctctgggaacctcacggccctgccctctcacctcgtgcccgccggccgcagcgtccgggtcttcatcagcgccaaccctgaaggtacgtccctcgctcgggtttgcccgtccgtccttctgtccgtcagcgctgcgggagctggagagtgtgtgtccgccccacagcccggtgcgccctgcgctcccttcctccagctaaagccgtggccgccctgagcgcgtgggaatttaatttgaatcactttttttctcccctcgctggccggttttgcctgcacacttctattaggacacccattctccaccccgggttattcccctgggtcaatccaagaaacatccaaggcattagccggcccttctggaagctccattctgccgccgccgccaccaccacctcctgtcccccgcccttttttttttttttaaagcggtttcttctccgagatgaccgcaaacacaaacagtagctctcctccccgaggcgggttcctgagtgcggggctacctccttggccactttttccagctgaggcgaggtgagttccttgagactctcctcctgcaggtgcgatggtgccctttgcagaggccaagcagacttttgtgaaccggaggtcgagggggacaccctctgtgggtcccggaacaggcttcgcggtggggcgcgcaggatgggctca

SEQ ID NO: 123390 - DNA, 55 bp, Homo sapiens; identical to SEQ ID NO: 92133
  chr4:37455430-37455485
  Hyper

SEQ ID NO: 123391 - DNA, 77 bp, Homo sapiens; identical to SEQ ID NO: 92141
  chr4:37892223-37892300
  Hyper

SEQ ID NO: 123392 - DNA, 30 bp, Homo sapiens; identical to SEQ ID NO: 92145
  chr4:38650068-38650098
  Hypo

SEQ ID NO: 123393 - DNA, 32 bp, Homo sapiens; identical to SEQ ID NO: 92147
  chr4:38732941-38732973
  Hyper

SEQ ID NO: 123394 - DNA, 116 bp, Homo sapiens; identical to SEQ ID NO: 28867
  chr4:39047287-39047403
  Hyper

SEQ ID NO: 123395 - DNA, 234 bp, Homo sapiens; identical to SEQ ID NO: 92151
  chr4:39448261-39448495
  Hypo

SEQ ID NO: 123396 - DNA, 30 bp, Homo sapiens; identical to SEQ ID NO: 92152
  chr4:39697732-39697762
  Hyper

SEQ ID NO: 123397 - DNA, 26 bp, Homo sapiens
  chr4:39790045-39790071
  Hypo
tttgtattcttaggccgggcttggtg

SEQ ID NO: 123398 - DNA, 145 bp, Homo sapiens; identical to SEQ ID NO: 92154
  chr4:39816644-39816789
  Hypo

SEQ ID NO: 123399 - DNA, 24 bp, Homo sapiens
  chr4:39817089-39817113
  Hypo
cgcccagcccgaaactggagactt

SEQ ID NO: 123400 - DNA, 30 bp, Homo sapiens; identical to SEQ ID NO: 92156
  chr4:39860480-39860510
  Hypo

SEQ ID NO: 123401 - DNA, 30 bp, Homo sapiens; identical to SEQ ID NO: 40281
  chr4:40479216-40479246
  Hypo

SEQ ID NO: 123402 - DNA, 100 bp, Homo sapiens; identical to SEQ ID NO: 40282
  chr4:40533094-40533194
  Hypo

SEQ ID NO: 123403 - DNA, 30 bp, Homo sapiens; identical to SEQ ID NO: 92159
  chr4:40543284-40543314
  Hypo

SEQ ID NO: 123404 - DNA, 206 bp, Homo sapiens; identical to SEQ ID NO: 92160
  chr4:40910280-40910486
  Hypo

SEQ ID NO: 123405 - DNA, 1134 bp, Homo sapiens
  chr4:41258716-41259850
  Hyper
cccaccaacaaatcccgtctccacaaccaccagattatctcaccggcgagtgagactgcaaggtttgggggcccggccgtaccactccgcgctgcgcacggggggttcgtacccatctggccgcgaccgtccgtttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgt

SEQ ID NO: 123406 - DNA, 81 bp, Homo sapiens; identical to SEQ ID NO: 40284
  chr4:41314285-41314366
  Hypo

SEQ ID NO: 123407 - DNA, 863 bp, Homo sapiens
  chr4:41362304-41363167
  Hyper
ggactgcaggtgctgcgcggccagtgcccgcgcgtcctactgctccggtgccgcagcgcccgctcccccgggcccgggtgcgccccactgggcgcgcgtctcccatatgatgccagacccatccgcccgcccctcagcagccggcggggcgcagggacgtgcggggcggccagcggattccctctatcgggccgggtgtgaacgggagggagacacgcagcgctcgctccgggttatttttagtccgtagctgtgctccccctccccgggggcggagcggccctcgaaggtggggaggagaagaagctcccggcgcctccgcgctcgctcccgcgggtcactcacggcgcgttggagcccgggcggcgccgggaacagctgccgcggcgtcctctagcagcgcgcggctctcccgggacctgcgccggccgggggcggggagaggcggggaggggaggccggcgggcgggaaggggcggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggtaggtgcgggtggctggcgggcggccttgcactggcgccctgagccacggacccgcgcacgctccgaccgcaggtccagccttgcctccccccaaccgcccccactttcttttgccagctgctccaggtcacccccccgggcctcggcgagccgcgaaaccttagcgctttggcattggaatcccgggcgagggtgggcgtgaaaggggacac

SEQ ID NO: 123408 - DNA, 415 bp, Homo sapiens; identical to SEQ ID NO: 92168
  chr4:41746821-41747236
  Hyper

SEQ ID NO: 123409 - DNA, 1382 bp, Homo sapiens
  chr4:41747445-41748827
  Hyper
cagacacacattccccgagacagacacaaactgacacgcagacacagccccctgagagtgccccgcgtccaggccgcgctgctcacaacccccgatcagcaggcggagccctggccccgctgcgaggccccaggcaggtgcgaagccagggaagtttgtttgttttgtttgggggttgaggaagggggtaggagtggggttgaaatgagggcgacgccgttttccctttattcttagcgcgattactttaggccctcaatgaaaaagccatggcagcagcgacgacaatagccttgggcctacccgctcgcccactcgcccgcccgggccctggctcgcccgctgtcgccgccgccgccgccgccgcaggattccagatcagaacatactgctcttcactaaggcggctttggcaccgttgggtctttggagcgaagataggacgctggcgaagggacccccaagcgaatccgggatggaggtgatggggccggggccgggagcccagccttgtccagggcccccagccgcagccaggcctccagctgccgccgctgccgctgccgccgccgccgctgccgcggccgccgccgctgctgctgcgccgcccttgccgggttcgcctcccgggcccccgggccccgccgcccccggagctccagccgggctgggcccgccgccgccgcctccattcgccccgcagctgggggtggggttgggattgggacctgggcccccagtgctgtccgggtcagtgctcttggcctctttgctctcgtcgtccctggaagagtcagactttttgcccgaggagccgttcttggccgcggccgctgcggctgccgctgcgcgctcctgcttgcgaaacttggcgcggcggttctggaaccacacctggcccaagacggaaggagagacggtgaagcagggggagaaagaagaaaatgggaaagaaaagcaccggttagggtggcccaagttctacttcggcttgttttaacaccctcctccccatgcgctgtgatcacccccgcgcgcacatccaccaagtctaccgcttcttattgctgtgcattttcggagaaactttcttagggggagtgagcacgccagggacatgaaggcttgcggcagagtttaaaaagccgcaggtcccagaaagacccgaaaagggaaggccttattttggtgggcctctgttcagtcggcttcttgagcaagccccgagctcgccattcacccctaagcctaagttctaaagttaaactctaattggtagaaggaaaagggatcctctctgggtttgctccgctgcccatccccggcctttgagcctggaagagcgtgcgatggtgcgcaccgcttctcggtcgggggctcac

SEQ ID NO: 123410 - DNA, 691 bp, Homo sapiens; identical to SEQ ID NO: 92172
  chr4:41749079-41749770
  Hyper

SEQ ID NO: 123411 - DNA, 497 bp, Homo sapiens; identical to SEQ ID NO: 28877
  chr4:41750102-41750599
  Hyper

SEQ ID NO: 123412 - DNA, 37 bp, Homo sapiens; identical to SEQ ID NO: 92174
  chr4:41751372-41751409
  Hyper

SEQ ID NO: 123413 - DNA, 181 bp, Homo sapiens; identical to SEQ ID NO: 28879
  chr4:41751719-41751900
  Hyper

SEQ ID NO: 123414 - DNA, 1861 bp, Homo sapiens
  chr4:41752312-41754173
  Hyper
gctctcccctgccaccgtgttttattgcgcactaaactgccgcggacgcagtaatggattaaacggggacagcggtcccccagccttgtgcttctttgcagggtgagtttcaggctcgtttcaggtggttgcaaatcctcggggcgtgaggaagcgctaaagtcgggagtgcagggagccggacctaccgaggatcctggtgatagttttatggggagggctgatagttttattgcagttgtatgttgtacaatgcgtatttgataaagaagggcccttggtgaccagtgtgcacttttttgtgcacgggggtgaaatgaaaataaatgtatacaaggttttactgcggcgggaaacaaattgcaacgctctaaatggtttttctttatggtcaccagacaagaggagaaaagggatgcaaacatctgtcttcagtcccctaaacctaaaggccagcaaagacggatgcgaatccaagtgctattacagcggagatttgtctttatttatcccgctctcatgaatatgaatttgcatttgggccgggaggtggctgtatccctttggactccacacatggaatttcccccacgctcatccccctccccaaccacttaagggaggtgggggataggttgtcaagcacaaggctgagatcgtccaagtttcttcgttccctcggatttcgggttgggggatgtgcttgctggttttctgaacgcaactctgccgccgaggcctgcactcaggagatgtggatgtagggagcacaggccggggtgtccaccgccagcccgctcctctgctgtagggtttaagcgcgtttccctgcagaagagagtgaccaggggtggtcaggaggtgatgaatttcggctccaaggcctatttttgacagtaaccaggttcacaccccgcttggcactagagccttactgcacctggggtgtgtctccgcgtggtgcagagcgcgcgctctactccggaagctacggccgggtgccgcgccaccgctgtgcgccctgggcctgatccctacgccctagtcgagtgcagggcagggcaatttcgccgtgggtcctagtttgctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcaggggacctggatgctgacggggcatcagagggtgtcaaaaggagaagctaagggatctgggcgaggtctcagccgaagggcgctggcaagggaagtgcttggccggggagggtgcccggggggcggtcaaggggcaggcccggggctctgtccctcccggtcctggggtcccttcccgtcccgcggttccggaacgcctcgccagccctctctgggcgccccctgctgccgggcgccccctgctgccggccgccccgggtcggggtgccgtgagccttctcgcctttgtaccaggagacctttcagcgccgggcccacacggtcggatgagcaaatgcgcttgacttcattttcccctttgtagaccttgtaggtttattttgttcagtgtcaccatccctcccccaccacccctggcctatcgtccctctgcccgtcttttgtggcccggggtcctgcttctgcttggagatgaaaggcgtgcggggctgggccaggccagagccccagccccagcgccctgttttgttccagttgtgctttctacacgcgagctctcccctaa

SEQ ID NO: 123415 - DNA, 662 bp, Homo sapiens
  chr4:41867511-41868173
  Hyper
acccccgggcctttgcgccaccgcaccaatttgcatccccaacgaatgcgcgctgccctgatccccgagcacgcgggtattaatgatcataaaaaactgggcgattacaaaaagagaaagtgctaaatcccgggagctggggcaagatttcaaaaggcaacacaccgaatccaagtctgtactttaacttttttaataacgatttttttttttctgggctggaagctcgcactgaatcctggaggaattgctaaatcggattaaggttatattttgcaacagactggatggagcaataaaggagagcgcgcggaaatgggacttcacccatcaattagatctctattagcagccaatgcaggcttcaccacaggaaatgtcacgtcccagccctagcggaccctttcgttccccacccccagctctcacctcccctgtccctggagttaaacaactcttctggcgcacacattggaactaaacaaacccttttgtgtggaatacggtttttgtgttttgttttttgtttttcttattgaacttgttttggaaccctgtaccacctgccttccccaaccccagcgcagcgagctaaccccgggacactcccaccccggccggctgaacaggttgcagcgcgacacctgcgctgtctgctgggt

SEQ ID NO: 123416 - DNA, 110 bp, Homo sapiens
  chr4:41869265-41869375
  Hyper
ctgcgcgccccccgccggcctgagtggcaccgcgtgcccctgccggggcgcggctcctgcactgcgggcgcgcaggcggcggcgggctctgccggcgccccttattagca

SEQ ID NO: 123417 - DNA, 433 bp, Homo sapiens; identical to SEQ ID NO: 92182
  chr4:41875374-41875807
  Hyper

SEQ ID NO: 123418 - DNA, 249 bp, Homo sapiens
  chr4:41881182-41881431
  Hyper
cccgctggccctggccgcgcgacaggaggctgcaggcacgtcctgcggctccggggcgaaggctagggaaggggatagagggaggtcgctgcggggagggggacagaggcaggcacagagtcctaaagagatttgagactcgcgctcctgcactttctatcccacgcgcccccatccgaggggacctcacccctgggaagactccaataaatgcaacccggcgccactcgattccgggataatttttaa

SEQ ID NO: 123419 - DNA, 30 bp, Homo sapiens; identical to SEQ ID NO: 28888
  chr4:41881717-41881747
  Hyper

SEQ ID NO: 123420 - DNA, 166 bp, Homo sapiens
  chr4:41882098-41882264
  Hyper
agagtatcacaagcccgccctactgatcacgcggagaggattccttcttcccctctttactccgcgccctgccgcggaaacccttcccgtggcctcgaactggtccccgacgactgcggggtacgcggggcccaaagccagactctactcccgcgcagatgcggga

SEQ ID NO: 123421 - DNA, 64 bp, Homo sapiens
  chr4:41882530-41882594
  Hyper
gaccggcagggttctcgccttaatctgtaccaccgtcccgtaaatctgtcgctcagcccatagc

SEQ ID NO: 123422 - DNA, 1552 bp, Homo sapiens; identical to SEQ ID NO: 92188
  chr4:41882880-41884432
  Hyper

SEQ ID NO: 123423 - DNA, 30 bp, Homo sapiens; identical to SEQ ID NO: 92189
  chr4:41993805-41993835
  Hypo

SEQ ID NO: 123424 - DNA, 87 bp, Homo sapiens; identical to SEQ ID NO: 92190
  chr4:41994052-41994139
  Hypo

SEQ ID NO: 123425 - DNA, 2395 bp, Homo sapiens
  chr4:42152702-42155097
  Hyper
ctcaggctgtggcctcgcaaccagcccatctcgctccctgcaggcaggcagtgggctgctttgccgggcagcgcccgcagactcgagataaaggagaggagtcgcggaccccagagtgggtgcctcccacgaggcgtttctgtaaggctcgggccgagatgctcgggaggggcaggaccccgcggcgcggcagcgtgccacggacggggacgaggggatggcggggacgacgacgtgggcggtgggagcagagtgcctgcgactcccggggcaggaaggaggggcgggatggttccccgcgcccgaaatccacggcgtggcggacgcggaggagccccgagtctcacaaccaaggggtgggaaggaaaagggacagagcgagacagagcgcccccgagaaacacaggcgcacaaaaaaagacagaaggaaaaacggaactgagagccagccagcatggactgcgacagcgtgagagtgcatcaaagaggtggcgaagaaagcactagaaggcaaaggagaagtggagagaagaagaaacaaatggaggaagaaggagaaagggaaaaagcagacggaaaaagtgaagtagtacgagggcgtcccagcggggcggcccgagaagctccagcttcttcccgagcggccgccgctatcccccgggggggcgtctggccccactccggaccacgcccgagcgatcctggtcgccgactgccacagccgtgcttcccggcgcgggatccaagccgcggagccacctgttaggcgcgcgccgtcggaagcccaggcgcggcggcgctggagaatcctctcgaagtttccgggtgcgcggggaggccccaggtgcgccccgacatcccgacacggcccagcacgggtaagtgtcggcggccccccgcttctccttcctgggtcccctcccgctgcccccggccgtggcgggaaggaaagttgtgcggagagttggtacctgcgctgagctccaggctggcgctgtcgctacccgtgccgccggtgccggcggccgccgccgcgcctgggccatacctgacgacagcggcgaacgaagacgacgaggaggcggcgggggacgcgggcggcggctgcgccggagtcctcaagtggccctgggatgtggcgggcgtgcaggacggcgacgacgacgaagcggcggcggcggcccggccgggcccgggggggtaggagctctgcgcctggaactgctgcggcggcggctcgctgctgctgatggagacggcggcgtgcggcgcgaagggcggcgggggcggcgggggcgcccgcacgtgcggcagctccaccagggtgggtcgctcgtagcgcttggccagcgccggtctcttgctggggaacgtcttgaggacgctgtaggggctgcgctgcttgtagattttggggacgctgggcccctcctctgccggctgcatctcttcctccatccggcgcctcggggccggtccctcggagcacgtcccctccccgccgggcgccgggctccgagggtgcctccgccgcctgcccgccgggtctgccctggtgcgcgcgtgtgggagggtgtgtgtctgtgccgtggccgccgccgccgccgcctgtcgctgaggctggcatcgccgagcccccgcgcggggggctgccgcccgagctcctgattgacaggctgcctcgccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccggcttccgaaacgagctcgtggcgccccctgcatgaccccaaactctcggggttgcacagaggaggggctagtcgttggggcggggtcgtcagagtacgtgtgtattacagcaagttcttctaccaatcgggaattgctctccgatccttctgaaaagaacctcttgaagatcttggcccgggtggtcgcgcggtgtttacggggctttggggtcctgctttccccgagcatcgcggcctctgagctcatgcggaacataaaagctcgcaaggcgtagaactttttcacgttttcatttgtttcccgtaggggccccgagaacgtgcatgacaccatgatttcccccccattataaagatgagaaaaccgaggctctgagaggttgaagggaattgcccaaagtcagacactcgggagtgtgcggctgtgttgcact

SEQ ID NO: 123426 - DNA, 151 bp, Homo sapiens; identical to SEQ ID NO: 40286
  chr4:42200720-42200871
  Hypo

SEQ ID NO: 123427 - DNA, 65 bp, Homo sapiens; identical to SEQ ID NO: 92202
  chr4:42316016-42316081
  Hypo

SEQ ID NO: 123428 - DNA, 29 bp, Homo sapiens
  chr4:42317313-42317342
  Hypo
gcccagagggagctcgtccccagatcaag

SEQ ID NO: 123429 - DNA, 2249 bp, Homo sapiens; identical to SEQ ID NO: 92204
  chr4:42398808-42401057
  Hyper

SEQ ID NO: 123430 - DNA, 30 bp, Homo sapiens; identical to SEQ ID NO: 92205
  chr4:42442205-42442235
  Hypo

SEQ ID NO: 123431 - DNA, 53 bp, Homo sapiens; identical to SEQ ID NO: 92214
  chr4:44448607-44448660
  Hyper

SEQ ID NO: 123432 - DNA, 107 bp, Homo sapiens; identical to SEQ ID NO: 92215
  chr4:44448966-44449073
  Hyper

SEQ ID NO: 123433 - DNA, 1677 bp, Homo sapiens
  chr4:44449437-44451114
  Hyper
tcgtgcagggagagccgctctctataaggagttaaccagcgcctgccccggacacccccgcggggcctccagcggggctcaaactggcggcggctcagcagggggcgaggggtgctgggaaacgccggggctgcgaacttacggaagaaaatgtactcggtgtagctgctccagatcttgtcgtcgcggtactggttgacgaaggcggcggtgcccgaggagttacacgccaccatgtggaagccggcctcggacaggcgatcaaaggcctgctccaagtaggtgaacttgaggtagaagcgggacgtgtacttctccggctgccggtcggggtcgcggctctcgttgagcgtgtccccgaagacctccttggccagcgcgatgcgcccgcacaccatgatgcgcgccacacgccggaatttggcgtcggcctggttgtcgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctccggcagcgcgagttgcttgtcccgcagataatccagcacgtacctgaaaaggaagccgtcccggtcgatgaagaagcgcgcccggctgtccctgggcagctcgccccggcgccgggcgccgccacggggactagagggcgagaacatgctggccaaagtactgtccgggacgctgagcagcgtcgagtgcttggtcacataaacctggccgcctacgttcagctccactacttcagggaagggcgagggtgcgcagggccccggggcggcggcggccgacgcgccgggcgagctggacgaggaaaccatctcgctaatgggcaggatggtgctgccgccgctgcccgtgtccttcagagccatagtccccccgccgccggcccagtgacccgagagagctgcactttctcgttcccggagcccgcgccccagccctccgcgtgctcctggcgctctgcgccctcggactgggcggcgcgttcctccgaccggggcggccccgctcagggttcggggcagcggcggcgtcggcggcgcccgagctccatcggaggagagacgcgcgagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtcatttaaagagataggctgcagccgcggctcccgggctccgacgctagggggcggggccgagagccgagcctgcaagagg

SEQ ID NO: 123434 - DNA, 52 bp, Homo sapiens; identical to SEQ ID NO: 92220
  chr4:45473410-45473462
  Hypo

SEQ ID NO: 123435 - DNA, 20 bp, Homo sapiens
  chr4:46067754-46067774
  Hypo
tttgagacagagtctcgctc

SEQ ID NO: 123436 - DNA, 32 bp, Homo sapiens; identical to SEQ ID NO: 28904
  chr4:46391678-46391710
  Hyper

SEQ ID NO: 123437 - DNA, 98 bp, Homo sapiens; identical to SEQ ID NO: 92224
  chr4:46392417-46392515
  Hyper

SEQ ID NO: 123438 - DNA, 37 bp, Homo sapiens; identical to SEQ ID NO: 92226
  chr4:46783708-46783745
  Hypo

SEQ ID NO: 123439 - DNA, 37 bp, Homo sapiens; identical to SEQ ID NO: 92227
  chr4:46806970-46807007
  Hypo

SEQ ID NO: 123440 - DNA, 1569 bp, Homo sapiens
  chr4:46994820-46996389
  Hyper
ttgcgcgtttgaaatcgttcatacccccaaatccaggacgcagcctgttgtcataaccatcgagcaaactgtccaggatgcgggtgaaattttctgtgcacaatttctcctccttttggttctgtcctggggattcgtttaaactgcaagcgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacacgcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctccggcttcgcagcccccgaccccaagtgggctccccgcccacagcagtgttcgtcctcctacctcctggccccctcccttccgctgggatttggatctaaccaatgaagctcctctgtcatcaggttgtgcgaggacctgtttgtacccagagtcaaggttggaggtggagaaagggcgggtgacggggactgctgggcgtcgggtggtagcggtggtgaggagaggggatcaagtccgggctcaaaccacctttgagaccctcccattcaggtgttatggggggcggtagggagagcaatgaaagcagaaagattcttcctggtaacaggggttgcagctcacccggcggactctcgccaaactattgggaagtggactcgagccgcactctagtcccagtatttgctaagctattgctttaaagacaccccatttctttacccgcctccaccagacacgcgcacaccctccgctttgctgctccatccttttctggagaggaggggagaggtggagacaagcgacctctggtcaaaatcactttcacttcttgcgacactcttctttt

SEQ ID NO: 123441 - DNA, 57 bp, Homo sapiens; identical to SEQ ID NO: 92230
  chr4:47033544-47033601
  Hyper

SEQ ID NO: 123442 - DNA, 965 bp, Homo sapiens
  chr4:47034011-47034976
  Hyper
ggacttcggaggtaacgcttcatcttttttcaacctgtaacccatccttagttctccttttctgtcaaagataaatgtcaaaaaaaaaaaaagaaaaggcatgtcattttcgtaagcgtgcactataccctgggcacacacacacacacacacacacacacacacaccccgggtccccagtctcaggtggatgaatcctcaggcggaggcgaccttctcccgggccgacacaccctctgcatagtcactgcatcacgcgtgtgcccacacctgttttcccaggcagtcccctgaaaggggtggtggggggagcagggagggagcccgttaagaatggagtaagggctgggaagcccccagaccctccccagcctgctgtcactgagagaatctgttcctaatgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgccgtggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcccggatgcaccaaggccctgccaccgagagcacagtctg

SEQ ID NO: 123443 - DNA, 263 bp, Homo sapiens; identical to SEQ ID NO: 92234
  chr4:47839267-47839530
  Hyper

SEQ ID NO: 123444 - DNA, 38 bp, Homo sapiens; identical to SEQ ID NO: 92235
  chr4:47915048-47915086
  Hypo

SEQ ID NO: 123445 - DNA, 92 bp, Homo sapiens; identical to SEQ ID NO: 92236
  chr4:48378917-48379009
  Hypo

SEQ ID NO: 123446 - DNA, 1231 bp, Homo sapiens
  chr4:48485255-48486486
  Hyper
agaaccacttactggcgattcacaggaggggaccgggcggcagggcggggcggggcctgcggggcgcggggccgcggcgcggagccggcgcagcgattgggttcacccggggggccgcgctgcgcggagtgccaggctgcgggcggctgcagacctgggagcggagaccggcccgccgcccccgacgccgccgagcacgtcagcggcgcgcagccggggctcggagaccgacgggcagaacgacgggcggcgactgcggcgaccgcgggacggcgagaggcacgcggcgggaggggaccggaatccgcagctccggccgcgccatggacggcaacgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcaggtacggatctgtctattccttgggcatctgtctcatcccagacgcgcgtttacggccgtgggctcacgacgaaggacagaggcagtggaggggttggaattaggcgtggaggaaggaggagaaaaggagaggaagttgatgacgccccggctttagaagtcaaggccgacctgcaggttgtgctgctaggggagcaagctagacggcgagggagctgctccaaggctgggattccatgcgcagcgcggcccttcagcagggtccctcgccgtcctccccgagcgtcggggtggcagcgcaggtcgttgtccagtggaa

SEQ ID NO: 123447 - DNA, 1097 bp, Homo sapiens
  chr4:48492180-48493277
  Hyper
cggtggcaggaagggcgtggagggcggtgcagcgtgcgagcccccgccgagggccatccccgcctccgctcggccgcccgggcaagtcgcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctgcgacgtggcggtgcaggtgagcccgcgcatcgacgccgcggtacagtgctcgctggggaggcgcacgctgcagcgccgggcccgcgaccccgagtccccggccggccccggggccgagggcaccacgggtggcggctctttctcccagcagccatcccgtcgaggcctggagcagggcagcccccagaacggcgccccgcggcccatgcgcttcccgcgcaccgtcgccgtgtactcgcccctggccttgcgccgtctcaccgccttcctggaggggcccgggcccgcggcgggcgagcagaggtccggggcgtcggacggagagagggggccgccgcccgcgcggcttcaaggcccagaggagggggaggtgtggacgaagaaggcgccccggcggccgcagtccgacgacgacggcgaggcccaggccgcagtccgagcgagctgggagcagccggccgacggtcccgagctgccgccgcgagaggcccaggagggcgaggcggctccgcggtcggcgctaaggagcccggggcaacctccgtcggcggggagggcccgagacggcggcgacggacgggaggcggccgtcgcgggagaggggccgtcgccacggagcccggagctgggcaaggagcggctgcgcttccaggtaaag

SEQ ID NO: 123448 - DNA, 30 bp, Homo sapiens; identical to SEQ ID NO: 92262
  chr4:48946783-48946813
  Hypo

SEQ ID NO: 123449 - DNA, 213 bp, Homo sapiens; identical to SEQ ID NO: 28916
  chr4:48987912-48988125
  Hyper

SEQ ID NO: 123450 - DNA, 68 bp, Homo sapiens; identical to SEQ ID NO: 28917
  chr4:48988465-48988533
  Hyper

SEQ ID NO: 123451 - DNA, 39 bp, Homo sapiens; identical to SEQ ID NO: 92269
  chr4:52708566-52708605
  Hyper

SEQ ID NO: 123452 - DNA, 23 bp, Homo sapiens
  chr4:52892709-52892732
  Hypo
atcgcgcccggcctaaattgctt

SEQ ID NO: 123453 - DNA, 140 bp, Homo sapiens; identical to SEQ ID NO: 92271
  chr4:52917545-52917685
  Hyper

SEQ ID NO: 123454 - DNA, 123 bp, Homo sapiens; identical to SEQ ID NO: 92272
  chr4:52917964-52918087
  Hyper

SEQ ID NO: 123455 - DNA, 159 bp, Homo sapiens; identical to SEQ ID NO: 92273
  chr4:53617401-53617560
  Hyper

SEQ ID NO: 123456 - DNA, 106 bp, Homo sapiens; identical to SEQ ID NO: 92274
  chr4:53617801-53617907
  Hyper

SEQ ID NO: 123457 - DNA, 960 bp, Homo sapiens; identical to SEQ ID NO: 92275
  chr4:53728037-53728997
  Hyper

SEQ ID NO: 123458 - DNA, 30 bp, Homo sapiens; identical to SEQ ID NO: 92278
  chr4:54858212-54858242
  Hypo

SEQ ID NO: 123459 - DNA, 40 bp, Homo sapiens; identical to SEQ ID NO: 92279
  chr4:54957438-54957478
  Hyper

SEQ ID NO: 123460 - DNA, 1712 bp, Homo sapiens; identical to SEQ ID NO: 92280
  chr4:54965799-54967511
  Hyper

SEQ ID NO: 123461 - DNA, 24 bp, Homo sapiens
  chr4:54969747-54969771
  Hyper
gagtgttgtctttagcgcgcgcgc

SEQ ID NO: 123462 - DNA, 684 bp, Homo sapiens; identical to SEQ ID NO: 28926
  chr4:54969831-54970515
  Hyper

SEQ ID NO: 123463 - DNA, 480 bp, Homo sapiens
  chr4:54975768-54976248
  Hyper
atattaatagtgtggcgaaagttttttgtgtgcgtgtccttttctaggtcgggggtggggaggggcggtgggtggacgcagagggaggaaggctcagccttggatccttgccacctgaacaacgtcgcctctgcccacgtggaaagcctcgcttgtctggcagccggggttctgaatggttgccgcgacccctgcgctcccagcagggccaagaggacctcgcgggcaccagcgtccgggcgggaagggacgtgtgcccaagcctcgcctcctggccctcagtgggctgggacgcccttgatcaccggcgcaggaaagaggctccccagcccgtgagcttcgtccgggcgccagggcagggatggctggtggtgtgcactggagagcacgacggtgacgctgcgtgggaaagagacgtgggaagggcatagccggattatccactcagctccaattttctccaagcgccactcaccccac

SEQ ID NO: 123464 - DNA, 22 bp, Homo sapiens
  chr4:55012635-55012657
  Hypo
ttttttcagagggagcgtcgct

SEQ ID NO: 123465 - DNA, 1228 bp, Homo sapiens
  chr4:55092907-55094135
  Hyper
aggggagaaaagacccgcagcccgcctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggtttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattccgcactctgatttttggggggatcgtttgttcccgctcattttctacaaacattacggtatcctgttagcattccgaacaaggggctgttcatatatttgccttcaatgatttcctgaagggacatgtggaagtaatagcgagcggtgcagtcacccaagctgaagatgcacgagagcgggtcgcgtagaagaactgcggcaatgggacccccagcgcagccccaggcgccctgttttcgaggctgacatcccaagatcctgtcctggttaggcacagcaccgcgcccgttggagtacttct

SEQ ID NO: 123466 - DNA, 170 bp, Homo sapiens; identical to SEQ ID NO: 92290
  chr4:55094514-55094684
  Hyper

SEQ ID NO: 123467 - DNA, 58 bp, Homo sapiens; identical to SEQ ID NO: 28934
  chr4:55096214-55096272
  Hyper

SEQ ID NO: 123468 - DNA, 103 bp, Homo sapiens; identical to SEQ ID NO: 28935
  chr4:55096538-55096641
  Hyper

SEQ ID NO: 123469 - DNA, 60 bp, Homo sapiens; identical to SEQ ID NO: 28936
  chr4:55097404-55097464
  Hyper

SEQ ID NO: 123470 - DNA, 976 bp, Homo sapiens
  chr4:55097812-55098788
  Hyper
cgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctg

SEQ ID NO: 123471 - DNA, 436 bp, Homo sapiens; identical to SEQ ID NO: 92296
  chr4:55099028-55099464
  Hyper

SEQ ID NO: 123472 - DNA, 278 bp, Homo sapiens; identical to SEQ ID NO: 92297
  chr4:55100066-55100344
  Hyper

SEQ ID NO: 123473 - DNA, 214 bp, Homo sapiens; identical to SEQ ID NO: 92299
  chr4:55350697-55350911
  Hypo

SEQ ID NO: 123474 - DNA, 184 bp, Homo sapiens; identical to SEQ ID NO: 92300
  chr4:55393636-55393820
  Hypo

SEQ ID NO: 123475 - DNA, 33 bp, Homo sapiens; identical to SEQ ID NO: 92301
  chr4:55406440-55406473
  Hypo

SEQ ID NO: 123476 - DNA, 36 bp, Homo sapiens; identical to SEQ ID NO: 92302
  chr4:55456469-55456505
  Hypo

SEQ ID NO: 123477 - DNA, 328 bp, Homo sapiens; identical to SEQ ID NO: 92303
  chr4:55523645-55523973
  Hyper

SEQ ID NO: 123478 - DNA, 74 bp, Homo sapiens; identical to SEQ ID NO: 92304
  chr4:55524220-55524294
  Hyper

SEQ ID NO: 123479 - DNA, 839 bp, Homo sapiens; identical to SEQ ID NO: 92305
  chr4:55524518-55525357
  Hyper

SEQ ID NO: 123480 - DNA, 227 bp, Homo sapiens; identical to SEQ ID NO: 92306
  chr4:55990946-55991173
  Hyper

SEQ ID NO: 123481 - DNA, 39 bp, Homo sapiens; identical to SEQ ID NO: 92307
  chr4:55991454-55991493
  Hyper

SEQ ID NO: 123482 - DNA, 358 bp, Homo sapiens
  chr4:55991863-55992221
  Hyper
cctcacccgggtacccggcggcgatctccagctccccaagcccatttacatctccccatttccccacacaactggactgcgctgggccccaagtcgcccaggagagaacatcccagagcaacaactttgtttctggtgtaaataaaaagtactcggtaacgggcgctgagcaactccaagatttaatcgcttgccggtccccgaaatttggggagcatcaccaggagcgctgcgaagagcagcgctccctcaccaggcgcgtcaaagtgcaggaccctcttcgccatcgcgcgcgtctgaagtggccgagaatctgcagcagtttggagccacaagggagaagcggatactcagccaa

SEQ ID NO: 123483 - DNA, 23 bp, Homo sapiens
  chr4:56213501-56213524
  Hypo
agatgcatcttaggccgggcgca

SEQ ID NO: 123484 - DNA, 30 bp, Homo sapiens; identical to SEQ ID NO: 92311
  chr4:56422506-56422536
  Hypo

SEQ ID NO: 123485 - DNA, 121 bp, Homo sapiens; identical to SEQ ID NO: 92312
  chr4:56501604-56501725
  Hyper

SEQ ID NO: 123486 - DNA, 37 bp, Homo sapiens; identical to SEQ ID NO: 92313
  chr4:56502430-56502467
  Hyper

SEQ ID NO: 123487 - DNA, 61 bp, Homo sapiens; identical to SEQ ID NO: 92314
  chr4:56503474-56503535
  Hyper

SEQ ID NO: 123488 - DNA, 476 bp, Homo sapiens
  chr4:56659621-56660097
  Hyper
agtggcgagtgggcacggctctcgggagagggaaggcagcgattccaggagtcggggtcgcctcgctgcgatggcaggttcagcttcggttcactaatcgcaaccagccccaccgcgggagacggggagagccctggctgctgcaggccggcacctgggtagatgttaccttttcccgcacagggtcagtccacagacgtgcaccagcaccccggcgaccggtcacagccttcccctcgccccgggcgggcgcggcctcagggagccctcagggcttggggccaggaccatggccatccacgcgcttcggcctcgcactccccgggtatgctgcgggccctctccatccggggaggcggggtccggggaggacacatccccggcccggcctctccgagagaccctttggatttttctcttccacaccgcctcatccgaggggagccccccaccccacaccccgcagtgatctgggg

SEQ ID NO: 123489 - DNA, 30 bp, Homo sapiens; identical to SEQ ID NO: 92320
  chr4:56936174-56936204
  Hypo

SEQ ID NO: 123490 - DNA, 44 bp, Homo sapiens; identical to SEQ ID NO: 92324
  chr4:57063851-57063895
  Hypo

SEQ ID NO: 123491 - DNA, 48 bp, Homo sapiens; identical to SEQ ID NO: 92330
  chr4:57180924-57180972
  Hypo

SEQ ID NO: 123492 - DNA, 79 bp, Homo sapiens; identical to SEQ ID NO: 92331
  chr4:57182183-57182262
  Hypo

SEQ ID NO: 123493 - DNA, 24 bp, Homo sapiens
  chr4:57252055-57252079
  Hypo
gagccaccgcgcccggccgagtca

SEQ ID NO: 123494 - DNA, 101 bp, Homo sapiens; identical to SEQ ID NO: 92333
  chr4:57252411-57252512
  Hypo

SEQ ID NO: 123495 - DNA, 30 bp, Homo sapiens; identical to SEQ ID NO: 92334
  chr4:57370899-57370929
  Hypo

SEQ ID NO: 123496 - DNA, 417 bp, Homo sapiens
  chr4:57371618-57372035
  Hyper
aggttgcttagactgcggcccacgtggaaggctcttagccaccctgcctggcccgaggtaatcgcgctagggacgctttttctgcagcaatgatataccccgccgaactgtcccacgtcctggttgggacctcttggtttcgcttggctgggctcaatccatccgtacgcctccgcccttccctctttgcgaacccctgcgggttcagcgaatcggctgcaagaagccctgcatccgcgaggtaagcggcggttggcggcggtgccggggttggcagcgcccgcgggttgtctacgccgcggggcctacgtctctgtcgggcgtgcacctcgggagccacacctggggcccagagccaccgctcagcacgcgggcacgcggcgggagggaaggaaaccgcggcgctggggatggaga

SEQ ID NO: 123497 - DNA, 217 bp, Homo sapiens; identical to SEQ ID NO: 92337
  chr4:57372287-57372504
  Hyper

SEQ ID NO: 123498 - DNA, 866 bp, Homo sapiens; identical to SEQ ID NO: 92338
  chr4:57396459-57397325
  Hyper

SEQ ID NO: 123499 - DNA, 1434 bp, Homo sapiens
  chr4:57521381-57522815
  Hyper
aattttttaaaaaatcggaaccaaatctccgtggcttcgtgcagcgtgagttctgcagctcgggggacgctgcagtgtgatgtggtggagagagcatgcttcaccgctcctgccatcctgacagcgccctccctcccggcctcagcctcctggttcgccaaaccggaggactgaatttatggctagctggtctctggggcgccttccagctctgacattcccgcctagaatagatcttcccgaaggtttcgcagacagaccagaggggaccgagccgggaaggcgagacagggacaggcgagagacgctgctcccaactcgcagagggagaaagcgtgtatcccgggctgccggggagagtggaaaagaaaggactggtgaccgaggggtttctgcgcagctcccggggaaccacggctggatgggggtggcggggagaccgggcgcccatgggagcggggaagcggggaggcggcggcgggagccatgcagggtctgggcccctgggatgcgggcagaagcgatgggagatcatggggagggcagcccggcgggaggcgcggacgaacaggaccgcccagccgcgagaaggctcagcccaggcaggggtcggggcgcgctgggcgcgtgtggggacgcacctgggtctcctcctcggaaaggcctgcctcggccgcgatgaggcacagcgtggtggaatccgggtgcttgtcgaccttgttgaagttgtactccaggatttccacctggtcctctgtggggccgctcgcggtctccgccgacatggtccctgcgcgctgcggggcagggagaagcggcggcggtgagcgaggcgtggagcgggcgggacgcagcgaaggaaggcggtcgcggcgccgccgggcagccccagccccaggccgccccctccagcggtgccacggccgcgcaagtccccggtggctgcacgctgagcgggggcttacggctgccccccacccgggcctccctccctggactgagcgctgttgcgggctgacggcagagcctagcgtcctgcgcctcccgcgccccccgggaccccttgcaggaactgtatccctgcctgcgacgggggcgagatagatgattccgcgggccctcaccgacctccggctctaaggaaggagtgaaggaagcgcgggggtgattttgagaaatccccttaaaaacttcctcccgaaagggggacctcccctggggacagacttgacagatcgcgagggtgggttcgcccgagtccgcgactagccggcctccggcctccccggtaggcggccttctgtctccgcagtgggttggcgctttggggccctctccaggcagggctgcacaccccacccttcctccaaaaaagttccccgcaagacaagttacttctcaaagttggggagacggaggcggtgcttttaatgt

SEQ ID NO: 123500 - DNA, 249 bp, Homo sapiens; identical to SEQ ID NO: 92343
  chr4:57687638-57687887
  Hyper

SEQ ID NO: 123501 - DNA, 95 bp, Homo sapiens; identical to SEQ ID NO: 92344
  chr4:57775782-57775877
  Hyper

SEQ ID NO: 123502 - DNA, 39 bp, Homo sapiens; identical to SEQ ID NO: 92345
  chr4:57777437-57777476
  Hypo

SEQ ID NO: 123503 - DNA, 30 bp, Homo sapiens; identical to SEQ ID NO: 92346
  chr4:57803508-57803538
  Hypo

SEQ ID NO: 123504 - DNA, 135 bp, Homo sapiens; identical to SEQ ID NO: 92347
  chr4:57906901-57907036
  Hypo

SEQ ID NO: 123505 - DNA, 1330 bp, Homo sapiens
  chr4:57975777-57977107
  Hyper
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgcccgcttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccactt

SEQ ID NO: 123506 - DNA, 30 bp, Homo sapiens; identical to SEQ ID NO: 92350
  chr4:57977334-57977364
  Hyper

SEQ ID NO: 123507 - DNA, 30 bp, Homo sapiens; identical to SEQ ID NO: 92360
  chr4:60685051-60685081
  Hypo

SEQ ID NO: 123508 - DNA, 16 bp, Homo sapiens
  chr4:61380678-61380694
  Hypo
gaagcagtctggatgc

SEQ ID NO: 123509 - DNA, 1821 bp, Homo sapiens
  chr4:62065803-62067624
  Hyper
cgaggcgggcctcgaagccactggagaggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctgcgcctaccccgcgcgcaggctgcacggtccccgcgcgcccgcgctctgacccgctgtctgcgcgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctgccgccgccaccgccgcctgtgactcgccccctcccctttctttcttctctttttgccttggtcctcttcctacgggtgtgcgcgcgcgcgggttgcacggtttgctttggcaggagctcgctcgtgtgtgcgcgtgtgtgagtgtgcgtgtctggagagcgccagtgcctcgctcgctcttggggagtcgaagaagagaaagaaccgaagagacagcggcggcggcgcagagcccggggccgcgcgatgaagctcccacatgcccgcagctgcccggcccggccggcgagctaatcatccaccccacgggctcggggttcgccggcccccgggacgcagccctcggcggccgggcgcccgctctgtctgcgcgccccctccgtgcaccggggaaggagtttgtgtggctctcgctccggctgtccgcggaggttgcgggcttgagaggggaccctcggctgggagagagcctcgggaggacgaagaggaggacggtttggcggagaagccacccctggccctcgcggctccccctacctattccatcgctcccgctccgaggcggaaaggggaggacgtggaagaagaaaaagaaagagaaggggggtggggtgggagaactggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaaggtaatttattcttcgcactcttcataataggggtcgccctggccgggcgcaggcggcggcatccaccgggcgggcaacaagagggggtgcggggtgcatgcacactcgcccttccactcacacactcgccctcacacacac

SEQ ID NO: 123510 - DNA, 522 bp, Homo sapiens
  chr4:62067873-62068395
  Hyper
agggcgacttttctccgtcaggctggaactggtgccgctggaggcgggagcgggctggaggacggacagggtctgggtgagaagctgggctctgggaagatggaaaatgcagggtgccgagcccggcgcgattctccctcaacgcttgcctggagcatccctggccccttttgcccaggtcgcgcccctgagtcttggagtcgcgctgcctccccgcgccctgcctgttgtgtctccttcacggcagtttggtttagacctgcgtgcccaggctttgttaggcggttttggctggagaaagctgccactttcgtgggtggcccgggctgcgctgtgctggtagtgggcactgggcggggggcggcggtgttgcacgaatccgggcggccgcggcgccggggcggggtgggcagagcattggtggtcgcggttggcgggttacaggtaggagagaaggcacctcggcgcttctctgaggagaagggaaggctccaggctgcagcgcagcgtctgagctgccgc

SEQ ID NO: 123511 - DNA, 30 bp, Homo sapiens; identical to SEQ ID NO: 28967
  chr4:62068633-62068663
  Hyper

SEQ ID NO: 123512 - DNA, 699 bp, Homo sapiens; identical to SEQ ID NO: 92395
  chr4:66533984-66534683
  Hyper

SEQ ID NO: 123513 - DNA, 1742 bp, Homo sapiens
  chr4:66534894-66536636
  Hyper
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaaggccagtggaaggggacgacaaataccaatttgagatgagactgcgatttagtctgcagcagcagcgtccagcgcgctgagacctgaactcccaggccccgcctagcccctccgccccaggtcgccacggtccccacccccatctccctaccttcgttgctggggctggccaggagggtccggagtgcggcgcacaggagaaggcacgtccagaggggagcccgtcgaggtgcagagtagcagccggccagggacgctggggtgatgggggtgtcgccgccgccgcttgggggccgccggcgtcccgcaccccggggccccgagccccgcatcttctccgagcctcctccggtgccgctgtcccgagcggctcagtccaccgcttcggcctcgcagagcggcgaagggagactcgggagtcctccttgtccccccttggggtcctacgccttctggcacgcggctcctccaaatgtaggaaccacggatccggctgagacagctgaagtttgcttctggctcctctcgcctccccctttggtggggttaaatgaaatattagttctggttgctagtgcagatctggactcggatcaagggtgtcgagagggtcctgggtcctgttcctttgcctttcaaaaagactttttacggattgagaatttttaaataccactaggggaaaggtgaaggttctttgcagccttcagtgttgaaatggacgaaggtaaggaaggcaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctgaagaggggagggactgacggctgccggccggtaggagcgcggagctgcgctgcggcggcccaggagctgctgcggttcccgctgctcggggagcaggcggtgtgtgcgcggctgcgaagtcgaggttgaaactgcaccgccaaggcgcgctcctgctgtgtctggagctccggcgtctcctctgcctcccagctcagcgcctcccaccctccttccctcctcctcttcccagctcccccgccctctgctgctcgcagcctcgccagtgagaatctactgtaagtgtgagttgcttcgacgaagtcacacacccacggagggaagtaatctggaggctgccttggtgagtgttgcctagcggtctccgggaaaggcgcgtcttcctcccgggataattagggcaaggaatcctgacgacgctggcgaggactggggttcccgggaggcggaagggagatcagccccagctcagccggcggcccttagagacgcgggtccctccgtttggcatcttgcctgctgtccctcacaggctgtggcatcaacaaccttgtcgtcacatcgccgcgcattcgcaggctctgctgg

SEQ ID NO: 123514 - DNA, 228 bp, Homo sapiens; identical to SEQ ID NO: 28972
  chr4:71600396-71600624
  Hyper

SEQ ID NO: 123515 - DNA, 25 bp, Homo sapiens
  chr4:71925563-71925588
  Hypo
gctcctcccccgaggtttgctcgtt

SEQ ID NO: 123516 - DNA, 237 bp, Homo sapiens; identical to SEQ ID NO: 92424
  chr4:72226735-72226972
  Hypo

SEQ ID NO: 123517 - DNA, 264 bp, Homo sapiens; identical to SEQ ID NO: 92430
  chr4:73433899-73434163
  Hyper

SEQ ID NO: 123518 - DNA, 439 bp, Homo sapiens; identical to SEQ ID NO: 92431
  chr4:73434804-73435243
  Hyper

SEQ ID NO: 123519 - DNA, 32 bp, Homo sapiens; identical to SEQ ID NO: 40297
  chr4:74468507-74468539
  Hypo

SEQ ID NO: 123520 - DNA, 194 bp, Homo sapiens
  chr4:74702331-74702525
  Hyper
gagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcg

SEQ ID NO: 123521 - DNA, 497 bp, Homo sapiens; identical to SEQ ID NO: 92439
  chr4:74809854-74810351
  Hyper

SEQ ID NO: 123522 - DNA, 458 bp, Homo sapiens; identical to SEQ ID NO: 92440
  chr4:74903976-74904434
  Hyper

SEQ ID NO: 123523 - DNA, 30 bp, Homo sapiens; identical to SEQ ID NO: 92441
  chr4:75200375-75200405
  Hypo

SEQ ID NO: 123524 - DNA, 30 bp, Homo sapiens; identical to SEQ ID NO: 92443
  chr4:75230457-75230487
  Hyper

SEQ ID NO: 123525 - DNA, 394 bp, Homo sapiens; identical to SEQ ID NO: 92444
  chr4:75230736-75231130
  Hyper

SEQ ID NO: 123526 - DNA, 29 bp, Homo sapiens
  chr4:75241002-75241031
  Hypo
taaagtaatgactagcgattctttttttt

SEQ ID NO: 123527 - DNA, 148 bp, Homo sapiens; identical to SEQ ID NO: 40299
  chr4:75241331-75241479
  Hypo

SEQ ID NO: 123528 - DNA, 66 bp, Homo sapiens; identical to SEQ ID NO: 92449
  chr4:75858458-75858524
  Hyper

SEQ ID NO: 123529 - DNA, 79 bp, Homo sapiens; identical to SEQ ID NO: 92450
  chr4:75858919-75858998
  Hyper

SEQ ID NO: 123530 - DNA, 65 bp, Homo sapiens; identical to SEQ ID NO: 92451
  chr4:75859363-75859428
  Hyper

SEQ ID NO: 123531 - DNA, 19 bp, Homo sapiens
  chr4:76394243-76394262
  Hypo
ccagcatcctgttcccgta

SEQ ID NO: 123532 - DNA, 574 bp, Homo sapiens
  chr4:76555331-76555905
  Hyper
aactagcaattccagcgctgttgtgatttcttctgcggacgcagtcacgagtccagggcgaagcaggcagggaggcaggtgggcctcggtccgccgcaagctcacacttaggaggaccacgggccgcatgctgtcgtcgtcaaggcaacgacctcactctgtccccaaccataggcacaaagtcttgggagacagatacggcccaggtcagaatgcgttcacggcaggcaccaacacctgtgaaggccaagggctagagagcaattagctgggtgagaggcaccacctcccagctcgtaaggcgcccagtacctggagcctgggaacctgcaccgctccaactacccctgggcgaaggcgttggccgcggagctgcaagggggggcggtttctcacccgccccgagagcgccaggcctcccttcttctgattggccgagccgagtcgtcacgagccatgattggctcagggccaaccaccccgccccttcacctagggctcggcccaggttctgctccctgacacgcagaggccctgcgtccccacacgccttggttctcgtcaggaggcgcct

SEQ ID NO: 123533 - DNA, 30 bp, Homo sapiens; identical to SEQ ID NO: 92459
  chr4:76860425-76860455
  Hypo

SEQ ID NO: 123534 - DNA, 44 bp, Homo sapiens; identical to SEQ ID NO: 92460
  chr4:76912367-76912411
  Hypo

SEQ ID NO: 123535 - DNA, 223 bp, Homo sapiens; identical to SEQ ID NO: 92461
  chr4:76912711-76912934
  Hypo

SEQ ID NO: 123536 - DNA, 39 bp, Homo sapiens; identical to SEQ ID NO: 92462
  chr4:77156176-77156215
  Hypo

SEQ ID NO: 123537 - DNA, 85 bp, Homo sapiens; identical to SEQ ID NO: 92463
  chr4:77172970-77173055
  Hyper

SEQ ID NO: 123538 - DNA, 52 bp, Homo sapiens; identical to SEQ ID NO: 92464
  chr4:77227473-77227525
  Hyper

SEQ ID NO: 123539 - DNA, 423 bp, Homo sapiens; identical to SEQ ID NO: 92465
  chr4:77228029-77228452
  Hyper

SEQ ID NO: 123540 - DNA, 30 bp, Homo sapiens; identical to SEQ ID NO: 92469
  chr4:77488004-77488034
  Hypo

SEQ ID NO: 123541 - DNA, 69 bp, Homo sapiens; identical to SEQ ID NO: 92471
  chr4:77610972-77611041
  Hyper

SEQ ID NO: 123542 - DNA, 177 bp, Homo sapiens; identical to SEQ ID NO: 92472
  chr4:77818008-77818185
  Hyper

SEQ ID NO: 123543 - DNA, 97 bp, Homo sapiens; identical to SEQ ID NO: 92473
  chr4:77818657-77818754
  Hyper

SEQ ID NO: 123544 - DNA, 35 bp, Homo sapiens; identical to SEQ ID NO: 92474
  chr4:77819538-77819573
  Hyper

SEQ ID NO: 123545 - DNA, 101 bp, Homo sapiens; identical to SEQ ID NO: 92475
  chr4:77869970-77870071
  Hyper

SEQ ID NO: 123546 - DNA, 152 bp, Homo sapiens; identical to SEQ ID NO: 92478
  chr4:78584348-78584500
  Hypo

SEQ ID NO: 123547 - DNA, 320 bp, Homo sapiens
  chr4:79472791-79473111
  Hyper
tacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttgggtaagttcagcctcccggcgcgtccccgcgagcctcgcccacagccgcctgctgacgggtggcttggggaggtcgcggcgcctcgcccagttcccccg

SEQ ID NO: 123548 - DNA, 166 bp, Homo sapiens; identical to SEQ ID NO: 92487
  chr4:79689605-79689771
  Hypo

SEQ ID NO: 123549 - DNA, 99 bp, Homo sapiens; identical to SEQ ID NO: 92488
  chr4:79861382-79861481
  Hypo

SEQ ID NO: 123550 - DNA, 63 bp, Homo sapiens; identical to SEQ ID NO: 92489
  chr4:80329437-80329500
  Hypo

SEQ ID NO: 123551 - DNA, 506 bp, Homo sapiens; identical to SEQ ID NO: 92491
  chr4:81106086-81106592
  Hyper

SEQ ID NO: 123552 - DNA, 1676 bp, Homo sapiens
  chr4:81123055-81124731
  Hyper
ctcactaagcagggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaa

SEQ ID NO: 123553 - DNA, 1853 bp, Homo sapiens
  chr4:81186703-81188556
  Hyper
ataacagtctggggacgttgcccgtacagggaaattctctgttctcaaggaaattttcccttctcgggtttcctgaggttgaaatccagcgcgcacgtcattaatcattcactgaggtcggtccctcagtcaatggcaggtctgggtaagctaaagcgagcagttagctaacccttcctgccacggggatcctggggcgaaagaggacaactgggcggtcagttacatgtgctggtgtccagccgctgcctctctttccccggtcggagcgcgggggtgcgtgtgccctcactctcacgaatacagacggagagcttcccagaaggaaaaacaaattcgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtaagttactcgctctcctacaaaacccgtcctaggcggccgcggaagattcgggagggacagcaggtattcgccgggacacaggctcaccttcctgagcccaggccactgggaccaagctgatactcagaaacagccgggcgggttgggtggagatgcatctatatggcgtgcgcacacgcacccctctcctgggcatgaggaattgcgatttctcaggtgt

SEQ ID NO: 123554 - DNA, 589 bp, Homo sapiens
  chr4:81189430-81190019
  Hyper
agatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaaagactccacgggccattgggctccttcttacacaggctccagaggagcgtggacaccaccggcggtctgaagatttggcagccagcagtctccagaggggggtcggaggcgcgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagcgagtcccagggcctccctcacactcccgagaggaatctatttccatattttagagtttatttcactcatcgaataactgctcat

SEQ ID NO: 123555 - DNA, 463 bp, Homo sapiens; identical to SEQ ID NO: 92502
  chr4:81256776-81257239
  Hyper

SEQ ID NO: 123556 - DNA, 465 bp, Homo sapiens; identical to SEQ ID NO: 92504
  chr4:81307611-81308076
  Hypo

SEQ ID NO: 123557 - DNA, 191 bp, Homo sapiens; identical to SEQ ID NO: 92506
  chr4:81951310-81951501
  Hyper

SEQ ID NO: 123558 - DNA, 100 bp, Homo sapiens; identical to SEQ ID NO: 28997
  chr4:81951777-81951877
  Hyper

SEQ ID NO: 123559 - DNA, 999 bp, Homo sapiens
  chr4:81951937-81952936
  Hyper
aactcggaccagccgcgccgcagctgctccaatccctggaaaaggcaatcgagcgccctccggaccgctgcgcacagccccggctccgacctggcgcccaaaacagagctagtcctagtccctcgcgcggccagtttggccgggtgttcccaaaaataaagcgaggagggaaggtacagacagatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcaggtgagtgcgcgaggtgagactcccttcccgcggtcccgccccagctttctcccgggaccccccacagcttccttgtctgccccttgcttggtggcgctgcctagggacctttctccgccctcctcagctgccctctggattcctccgtccagtcacaccccgcgtgtcgccagctgcatctc

SEQ ID NO: 123560 - DNA, 1291 bp, Homo sapiens
  chr4:82135686-82136977
  Hyper
caactacccagagctcgacgaagcaaagccgggagcgcaagccctgacagcaccgccaagcccctagctcggagcaacagcctccaccgcttctcctcgctaaacctagagaaccctgaggactccccactggggctgagcccctcccgccctcaacagaacctctaaacacaagtagcctttccctgcctccaggagctcacgaaacgctgccacaccgagcgaatgcaacgcgtacacacgtccacactcgaacagcacaagcaagagaccggctgggtgtggaatagaggcgcacatcgcgcaacgcattcacagcatgcacacgcgcgcaccccgaccccgtccctccccgcgcgccctcacaccccggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccagcgcaggtcagctcagccagccccgccgtgcacacggtgcgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagacacgcagggagggagggaagagaggagggaaggaggagggagggggtcagccggggctactgcctggatagttgggcgccggcttccctaaaggtggggtcacccgcgcccgcacgcacactagcccgaacctttactcccgacacagccgcagtctgcactttataccccataccctccatagtgaggcaacttaagtagggcgataacatcgtggttgtaagcatttttgttcatgttattatttctatttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggcaggggttgaatcgagtttcgagggacagagattataccttccgaatctgcaggtct

SEQ ID NO: 123561 - DNA, 86 bp, Homo sapiens; identical to SEQ ID NO: 92515
  chr4:82157454-82157540
  Hypo

SEQ ID NO: 123562 - DNA, 577 bp, Homo sapiens; identical to SEQ ID NO: 92522
  chr4:82965332-82965909
  Hyper

SEQ ID NO: 123563 - DNA, 34 bp, Homo sapiens; identical to SEQ ID NO: 92523
  chr4:83149079-83149113
  Hypo

SEQ ID NO: 123564 - DNA, 153 bp, Homo sapiens; identical to SEQ ID NO: 92525
  chr4:83301224-83301377
  Hypo

SEQ ID NO: 123565 - DNA, 169 bp, Homo sapiens; identical to SEQ ID NO: 92526
  chr4:83323412-83323581
  Hypo

SEQ ID NO: 123566 - DNA, 688 bp, Homo sapiens; identical to SEQ ID NO: 92527
  chr4:83482684-83483372
  Hyper

SEQ ID NO: 123567 - DNA, 144 bp, Homo sapiens; identical to SEQ ID NO: 92528
  chr4:83551716-83551860
  Hypo

SEQ ID NO: 123568 - DNA, 42 bp, Homo sapiens; identical to SEQ ID NO: 92529
  chr4:83718792-83718834
  Hyper

SEQ ID NO: 123569 - DNA, 91 bp, Homo sapiens; identical to SEQ ID NO: 92530
  chr4:83719334-83719425
  Hyper

SEQ ID NO: 123570 - DNA, 21 bp, Homo sapiens
  chr4:83955217-83955238
  Hypo
tacagacgtgagccacggcgc

SEQ ID NO: 123571 - DNA, 30 bp, Homo sapiens; identical to SEQ ID NO: 92534
  chr4:84030886-84030916
  Hyper

SEQ ID NO: 123572 - DNA, 41 bp, Homo sapiens; identical to SEQ ID NO: 14696
  chr4:84169961-84170002
  Hypo

SEQ ID NO: 123573 - DNA, 704 bp, Homo sapiens
  chr4:85402721-85403425
  Hyper
atttgtaactgaaggcggctctgcctcccctctgtctaccttgcggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgtca

SEQ ID NO: 123574 - DNA, 956 bp, Homo sapiens
  chr4:85403776-85404732
  Hyper
ctgtggttgccttttcggtttcaaagtaataaccaagcaaggaagagagaagaccgaaaactaccccgcggaaactagcacagtgtgcctggatgtctgtgtcccgggacctcggggaagagggcccgcaccggtctgcgaattgcaaggcccggccttccccagcgacgctctggtatccgctgtcccctccctgtacctccgcgacccaggggacgcccagtgcaccaggcccttccccggggtcagcggaggcgcagggcgttagccacatcagaggtgcaaatttaccccgggcccaggggaaaatggcgacagcgttcgcggctccacccggggcgcgtgtcagcgttggagagcctgcccggcctgcagagggcgtaacaggcaccgctggggagagccaagcacccctgcgtccaggatccgtagcgccgagctgcaggcccgacctgcagggggcgtgcccggcatgggaagctcaggctacgtctccgaagcttgcgctgaaaacaccagaggtagggaaaacggggagagcgtactgtgctgggctctaccctggacaccccagtttcattctctgcgaagccacgcgctggcagggctctcgggacggcgatacccagggatgatggtacccctggtctcggcgggacctcccgggaacttgtcctgggggagggagcccaactggccacgtactggtagcagcagtgggtggagcgcacaaactccgaggcccgcgtatgcccagcaccccaggctgaggctgcagggccccggacccgggtcccagggacggagcctgcccccagcactagggaactgggccaggtatggtgaccaacgtcctaaatcccaaacagacttcgttcggccgggctcagtaaagaatttgccgaaaggtagaaactggaccagagaagggaacacagtgccgggcacatcctagc

SEQ ID NO: 123575 - DNA, 30 bp, Homo sapiens; identical to SEQ ID NO: 92542
  chr4:85405081-85405111
  Hyper

SEQ ID NO: 123576 - DNA, 957 bp, Homo sapiens
  chr4:85414067-85415024
  Hyper
ccctaccccgccgcccgcgggggcaaaatctgggggcgagggggacccgggcgctgaggccgctgcccgcctatggggacgcggctgggaccgtggcccggctgcgggtttcagtagcgacatttacgcagtgcatttggtggtctttcttgccttatcaaccccggagtctctctcccctacatcccctcccacaacttcaaggttaaaaaaatagatatgtacatctcaaaaatagcaaagggtccccgcaggcagggccgggtcctccgggccccgaggagcgggcaggcgcggcgtgcacgcggtccccgcgcccctcgcggccccagaggtggaggccggagccgggaaggtgcggcgggcggcggcgttcaggatgagctctccggctcggacgcgtgcagtaggaggccgccgccgccgccgctgctggacttgtgcttcttcaacagctgcgtgattttctcgtcgtccgagttgggatccagaggcttattgtagtcgtcgtcctcttcctcgttctccgaggcccccttgaggcgctctgtctccgagtcctgcttcttcttggccgtggccatctcggcagcgtgcttcttcctccacttggtccggcggttctggaaccagacctgagggcggagaaaagggaggagaggggaggcaagggcgaggaattaaacgagcagatccaggccatgctaccactcccgcatctcgatggccctcccgcggccccccgaaggcctgctgccctccctcgcagccctcccttttctcggccgtcaaagtcagtctccgtcgccccaagttccccctgagtaactggcaccaacaaactgactgccgttgccatagcgatggtaacacaagagtattgaggttgtcagtgagcgagttctcaaaagtaaaaacaaaactcggaaacttaaaaatgagcgtccctaaaagtga

SEQ ID NO: 123577 - DNA, 30 bp, Homo sapiens; identical to SEQ ID NO: 92546
  chr4:85416612-85416642
  Hyper

SEQ ID NO: 123578 - DNA, 479 bp, Homo sapiens; identical to SEQ ID NO: 29016
  chr4:85416904-85417383
  Hyper

SEQ ID NO: 123579 - DNA, 107 bp, Homo sapiens; identical to SEQ ID NO: 92548
  chr4:85417612-85417719
  Hyper

SEQ ID NO: 123580 - DNA, 1938 bp, Homo sapiens
  chr4:85417953-85419891
  Hyper
gggtgttgagctccacgatgtccccaaatgtgcccggacgcagcgtgtgccagcccccagagtggaggcaggtgggaaagcgcgggcccagcgctggtgagcggctggaagcgctcgccctgccctggggacgctggactgtcttcaatgggctcacccaggccgagtgtactcgggcggcgagggcgaagaggtgaggtggggacaccccaggcggagacgtgcatgcaaatacactcacttcccgggcggtggagggctcaccgctgccgggcctcactgcttcgaagagaggcagcgggttaggctggcgaaggcggaatggggcgctggacgacagggaggagccgggaaagcagagatgcagtggcctctcctcccctctcctccccatctttctaatccaggccaggcctgcggtcctggccaggccgtttcaggaacagccagggcctcggacgagacacacgtccctcaccgcgttgtggtccacacgaacacacacacaccggctcagcccaggcgtactcaagacttagagagagggaggcgcttggatacagccacgcgagctcagaaaagcgagaatccctttctggaagccctggcccaacctaactggtgtgattccggcgctgtcaaactactggggcgggccacaggatggactgagcggcatgcacaccaggggccgcgacccgggagtgggcagaacaggcacggcaggcaggcatcggggcgcgggtggtagtactcacgaggggtacaggccaggcgtgcgtccctccagggcgggctctgcatcactccgggccagaagatgggcgtccggccaggcagctcagccagcggcttggggtaccggcccacggcggccacggccgcggcgctggggctgaagtagagcccgggcggcggcggcggcgggctcaggctgctaaagcgtggcagtccggccagcagccccgccggggatgaggcggcggctgcggccgcggcagcagccgcggcggcggcagaggcggaggaggcagaggcggacgaggaagaggaggaggaggaaccggagggcgaggcggagggcagggcggcccccgaggccacgggcatggagggccggctcaggatatcgttgatgccgtgtggggtggcggccgagagctgctgcggggggctgccgagggatgagagcccccccgtggccgggggcttcaggccgcctgggttgtgggtgcccagaggcggggagggcgacgaggaggacgacgacgaggacgaggaggagggggggccggcaggcagcgggggatacgcggcagggtacagcggggtcttcatctcggccatgctgtgcagggcggccaggggagggctgctgagcaggaatgcgctctgccgggtgccctccattgcccccaccgctaacatcccacggccacgccggagaccgtagccttgcagcgagggcgctggctggtgccccccgcggggctcagaggagccggaagcgccgagggcgcgagcggagaggcactcggcgcgcccggaggcgagctgccaactgaaccaaaaatgccgctgccgggagttgctcgcctagctgcgcagcagagatgtccaaaccctccacgcgggaggcggcagctcgccgagaaaagcaggcgtcccggcgggctaggcagtcctttcgttccgcgagtcctagattcgatccctggctattctctcttcctcacttttcctagctgttcaaagtgcgctacttctcatcttctgcccccgggaaataagcaaaacaaaacccaggctggctccggagagtttgtagcaaagttagttgccgaatctccactttgaagttggagggtgggggtggcttgctttctttggggaggttcaaaggacgccttgtgcagcccgtggcgctcctctgatctt

SEQ ID NO: 123581 - DNA, 30 bp, Homo sapiens; identical to SEQ ID NO: 92554
  chr4:85421883-85421913
  Hyper

SEQ ID NO: 123582 - DNA, 279 bp, Homo sapiens; identical to SEQ ID NO: 29023
  chr4:85422188-85422467
  Hyper

SEQ ID NO: 123583 - DNA, 629 bp, Homo sapiens
  chr4:85422771-85423400
  Hyper
agtaaatagttgcaacgcttggtgtaaggatgtctccatcgttcacttttacgtatcatttgcattgccaaattaaaatggcagcattgttcttaattatgacaataaaaaattccggatccgtgtaccttgatccctggtagtgagggggtgagccccgggtgctcgatcccgcgtagagcagcgtgtattgcagacgcacgctgggcagcacgggaaggcaggccggtgcctcctgccaggtgctagttgtagtggatctgctgcctgtctacagctgggagcggtgacaacgatggagcgtcctcggagagggtgggctgccccctgtcactcccgggggaagatcgccctgccctccgctctaactgcgtggttgaaaccagtttcgggacccgagtcctggtcccgctgacgcgggaggcttgtttctggtggggcagtcttaacgcattgccttcagatgcctttgagagtcaggacttgctctttcttggggatcctccgaaaccagcatgccttcctgcccacgacctaataaagtgggactttttcaagtaccccttgggagtggacgtgtaacacgtggtcgcaaggatcccggcgcatctctacgcagtatatctaat

SEQ ID NO: 123584 - DNA, 197 bp, Homo sapiens; identical to SEQ ID NO: 29025
  chr4:85423633-85423830
  Hyper

SEQ ID NO: 123585 - DNA, 372 bp, Homo sapiens; identical to SEQ ID NO: 92559
  chr4:85424135-85424507
  Hyper

SEQ ID NO: 123586 - DNA, 36 bp, Homo sapiens; identical to SEQ ID NO: 92560
  chr4:85503856-85503892
  Hyper

SEQ ID NO: 123587 - DNA, 558 bp, Homo sapiens; identical to SEQ ID NO: 92561
  chr4:85504235-85504793
  Hyper

SEQ ID NO: 123588 - DNA, 86 bp, Homo sapiens; identical to SEQ ID NO: 92564
  chr4:85887114-85887200
  Hyper

SEQ ID NO: 123589 - DNA, 49 bp, Homo sapiens; identical to SEQ ID NO: 92565
  chr4:85887878-85887927
  Hyper

SEQ ID NO: 123590 - DNA, 34 bp, Homo sapiens; identical to SEQ ID NO: 92566
  chr4:85888365-85888399
  Hyper

SEQ ID NO: 123591 - DNA, 30 bp, Homo sapiens; identical to SEQ ID NO: 40312
  chr4:86922651-86922681
  Hypo

SEQ ID NO: 123592 - DNA, 495 bp, Homo sapiens; identical to SEQ ID NO: 92583
  chr4:87281168-87281663
  Hyper

SEQ ID NO: 123593 - DNA, 1009 bp, Homo sapiens; identical to SEQ ID NO: 92584
  chr4:87515216-87516225
  Hyper

SEQ ID NO: 123594 - DNA, 30 bp, Homo sapiens; identical to SEQ ID NO: 29031
  chr4:87813050-87813080
  Hyper

SEQ ID NO: 123595 - DNA, 92 bp, Homo sapiens; identical to SEQ ID NO: 92588
  chr4:87813420-87813512
  Hyper

SEQ ID NO: 123596 - DNA, 37 bp, Homo sapiens; identical to SEQ ID NO: 14697
  chr4:87899606-87899643
  Hypo

SEQ ID NO: 123597 - DNA, 32 bp, Homo sapiens; identical to SEQ ID NO: 92591
  chr4:88010203-88010235
  Hypo

SEQ ID NO: 123598 - DNA, 30 bp, Homo sapiens; identical to SEQ ID NO: 40315
  chr4:88025280-88025310
  Hypo

SEQ ID NO: 123599 - DNA, 25 bp, Homo sapiens
  chr4:88296877-88296902
  Hypo
agcaaaactccgtctcaaaaaataa

SEQ ID NO: 123600 - DNA, 30 bp, Homo sapiens; identical to SEQ ID NO: 92623
  chr4:89054393-89054423
  Hypo

SEQ ID NO: 123601 - DNA, 128 bp, Homo sapiens; identical to SEQ ID NO: 40316
  chr4:89116521-89116649
  Hypo

SEQ ID NO: 123602 - DNA, 106 bp, Homo sapiens; identical to SEQ ID NO: 92626
  chr4:89291663-89291769
  Hypo

SEQ ID NO: 123603 - DNA, 628 bp, Homo sapiens
  chr4:89378317-89378945
  Hyper
gttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgagtgagtggggctggtgtgtgagggctgtgagggctgtgaggggtgagggctgagggctgtgaggggcgggcagccgggggtccgcgcctgagggaggagagcccagaaggccgcagacgcgcgcctggctcggatagtttcgccgacggcgcacctgagctgtcttttatcccggtcagtgtcaggcgcggggtgagcgggatactggcgaccagcggatcctccgctcagcaaagtggccggtgcggggcatgcgggca

SEQ ID NO: 123604 - DNA, 133 bp, Homo sapiens; identical to SEQ ID NO: 92630
  chr4:89660145-89660278
  Hypo

SEQ ID NO: 123605 - DNA, 20 bp, Homo sapiens
  chr4:89912577-89912597
  Hypo
gactccgtctcaaaataaaa

SEQ ID NO: 123606 - DNA, 91 bp, Homo sapiens; identical to SEQ ID NO: 92633
  chr4:90031770-90031861
  Hyper

SEQ ID NO: 123607 - DNA, 106 bp, Homo sapiens; identical to SEQ ID NO: 40318
  chr4:90043853-90043959
  Hypo

SEQ ID NO: 123608 - DNA, 1882 bp, Homo sapiens
  chr4:90757517-90759399
  Hyper
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatctaggaagagccggaaagggtcctgagggtgaaagggagactactaaggaagagtcacaggttgaggaggcaggagaaggctcagcaaatcctctttccacgccactatcaccattttcctttccaccaatcagcgcctgccagacgctgattttcccatcagtggaacaaggaataaatattccccagccgtctaaaacaagcggtcctaaggcttttcgctctagaaatgggacttactttgcagacctccctttatctgggagacaaatccagcgtgatttagcctaccggaccatcatatccaatttcttcttcagccccttctgaaagggagatgctacacaccactcacctttctgacttctgattctcgttgccctcagaattgacacccccttttctctccccccacccaccacacgcacatgcacacagacatacacacgcgaacttcaagacaatttttgcatcgcttaacacatttt

SEQ ID NO: 123609 - DNA, 94 bp, Homo sapiens; identical to SEQ ID NO: 92638
  chr4:91049775-91049869
  Hyper

SEQ ID NO: 123610 - DNA, 203 bp, Homo sapiens; identical to SEQ ID NO: 40319
  chr4:91168356-91168559
  Hypo

SEQ ID NO: 123611 - DNA, 163 bp, Homo sapiens; identical to SEQ ID NO: 92641
  chr4:93225260-93225423
  Hyper

SEQ ID NO: 123612 - DNA, 30 bp, Homo sapiens; identical to SEQ ID NO: 92642
  chr4:93225709-93225739
  Hyper

SEQ ID NO: 123613 - DNA, 49 bp, Homo sapiens; identical to SEQ ID NO: 92643
  chr4:93226097-93226146
  Hyper

SEQ ID NO: 123614 - DNA, 46 bp, Homo sapiens; identical to SEQ ID NO: 92644
  chr4:93226463-93226509
  Hyper

SEQ ID NO: 123615 - DNA, 35 bp, Homo sapiens; identical to SEQ ID NO: 92645
  chr4:93226820-93226855
  Hyper

SEQ ID NO: 123616 - DNA, 30 bp, Homo sapiens; identical to SEQ ID NO: 92647
  chr4:94749499-94749529
  Hyper

SEQ ID NO: 123617 - DNA, 246 bp, Homo sapiens; identical to SEQ ID NO: 92648
  chr4:94750031-94750277
  Hyper

SEQ ID NO: 123618 - DNA, 1043 bp, Homo sapiens; identical to SEQ ID NO: 92649
  chr4:94750556-94751599
  Hyper

SEQ ID NO: 123619 - DNA, 20 bp, Homo sapiens
  chr4:94752906-94752926
  Hyper
ggaaaagctaatagtcgtgc

SEQ ID NO: 123620 - DNA, 268 bp, Homo sapiens; identical to SEQ ID NO: 92651
  chr4:94753279-94753547
  Hyper

SEQ ID NO: 123621 - DNA, 555 bp, Homo sapiens
  chr4:94755600-94756155
  Hyper
aaaggggaaactgagcggagaatgggttaaatccttggaagcaggggagaggcaggggaggagagaagtcggaggagtataaagaaaaggacaggaaccaagaagcgtgggggtggtttgccgtaatgtgagtgtttcttaattagagaacggttgacaatagagggtctggcagaggctcctggccgcggtgcggagcgtctggagcggagcacgcgctgtcagctggtgagcgcactctcctttcaggcagctccccggggagctgtgcggccacatttaacaccatcatcacccctccccggcctcctcaacctcggcctcctcctcgtcgacagccttccttggccccccaccagcagagctcacagtagcgagcgtctctcgccgtctcccgcactcggccggggcccctctcctcccccagctgcgcagcgggagccgccactgcccactgcacctcccagcaaccagcccagcacgcaaagaagctgcgcaaagttaaagccaagcaatgccaaggggaggggaagctggaggcggcagaggcggcgg

SEQ ID NO: 123622 - DNA, 89 bp, Homo sapiens; identical to SEQ ID NO: 92656
  chr4:95127590-95127679
  Hypo

SEQ ID NO: 123623 - DNA, 29 bp, Homo sapiens
  chr4:95128039-95128068
  Hypo
gctgggattacaggcgtgagccaccactc

SEQ ID NO: 123624 - DNA, 146 bp, Homo sapiens; identical to SEQ ID NO: 92660
  chr4:95678853-95678999
  Hyper

SEQ ID NO: 123625 - DNA, 266 bp, Homo sapiens; identical to SEQ ID NO: 92661
  chr4:95679059-95679325
  Hyper

SEQ ID NO: 123626 - DNA, 106 bp, Homo sapiens; identical to SEQ ID NO: 92662
  chr4:95679639-95679745
  Hyper

SEQ ID NO: 123627 - DNA, 29 bp, Homo sapiens
  chr4:95762900-95762929
  Hypo
gagctgttcctattcggccatcttggctc

SEQ ID NO: 123628 - DNA, 30 bp, Homo sapiens; identical to SEQ ID NO: 92665
  chr4:96061185-96061215
  Hypo

SEQ ID NO: 123629 - DNA, 25 bp, Homo sapiens
  chr4:96180202-96180227
  Hypo
cgcccggcctcgaccatcttattct

SEQ ID NO: 123630 - DNA, 400 bp, Homo sapiens; identical to SEQ ID NO: 92667
  chr4:96469013-96469413
  Hyper

SEQ ID NO: 123631 - DNA, 496 bp, Homo sapiens; identical to SEQ ID NO: 92668
  chr4:96469768-96470264
  Hyper

SEQ ID NO: 123632 - DNA, 499 bp, Homo sapiens
  chr4:96470693-96471192
  Hyper
ttgcagggagatcagcgcccaggagaccagctgtgggtttgcccgctgaagccgaggcgagacagaccaggggacgaagcggctgcggagagtggcagcgcgcctgcctcccgcggtgcgccagacctggacgccgggagtgcagcgggcgcgccccgggccactaggctgtgtccagtggagctcagcctgccgcctgccaccttcttcgccgcgccggcaaagcctcagccgaattccctaggactggactcggtctacgacttcgggtctcgcggttgacgaagccggtgcgggctcgaactgaagtccttcttggttggggaagaaggcatgaagcttttgcactgccccagccggctgctgtcctggggttgtcagcgccagtcagactgctttatgttctgagcgcgtatgacccctttgcagtggaacagaaactaaaagctcgacggaaactcattctgcaacagtgctttctttgcgtgcatgttggtgg

SEQ ID NO: 123633 - DNA, 79 bp, Homo sapiens; identical to SEQ ID NO: 92673
  chr4:97118687-97118766
  Hypo

SEQ ID NO: 123634 - DNA, 18 bp, Homo sapiens
  chr4:97118826-97118844
  Hypo
ccgcggatctgacaggag

SEQ ID NO: 123635 - DNA, 106 bp, Homo sapiens; identical to SEQ ID NO: 40325
  chr4:99495888-99495994
  Hypo

SEQ ID NO: 123636 - DNA, 30 bp, Homo sapiens; identical to SEQ ID NO: 92683
  chr4:99503312-99503342
  Hypo

SEQ ID NO: 123637 - DNA, 30 bp, Homo sapiens; identical to SEQ ID NO: 92684
  chr4:99559227-99559257
  Hypo

SEQ ID NO: 123638 - DNA, 171 bp, Homo sapiens; identical to SEQ ID NO: 92685
  chr4:99579127-99579298
  Hyper

SEQ ID NO: 123639 - DNA, 30 bp, Homo sapiens; identical to SEQ ID NO: 92689
  chr4:99846517-99846547
  Hypo

SEQ ID NO: 123640 - DNA, 78 bp, Homo sapiens; identical to SEQ ID NO: 91402
  chr4:100729677-100729755
  Hyper

SEQ ID NO: 123641 - DNA, 725 bp, Homo sapiens
  chr4:101111245-101111970
  Hyper
ggctcctaaaatgcccggcgtcccgggagcgaactagcggaggaactcctttgccaaaggggtggaaccggcctctgcaactcaatttgacaaagccctgggagcggagccgcaacctgaaactaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcacccctcccgggccaccctgcgccggctcctcgcagtagcatagcctccggggcagcgagaactttataggtccagtccccaccctgctcaggcccgcccacctgcaccgcccctccccggccagcgccccgcccctcccctccagagtctggtcccctttcaacctctacacttccagggagcccgagcctagccacagggagttgaggataagcctgtggtagagcggacacctgttgcttccagggtagatctcgggccactgggaccgcaattccgggtgcacgactcgtcaaagcctgaacctgattgttcagtgcgacccctccccgagcgtccgcgctttcacactcaggctgctcccggcagcgggaagctttaagc

SEQ ID NO: 123642 - DNA, 24 bp, Homo sapiens
  chr4:103350988-103351012
  Hypo
ctgaggcaggagaatcgcttgaac

SEQ ID NO: 123643 - DNA, 17 bp, Homo sapiens
  chr4:103399288-103399305
  Hypo
ctagccaagggaagccg

SEQ ID NO: 123644 - DNA, 30 bp, Homo sapiens; identical to SEQ ID NO: 91417
  chr4:103658311-103658341
  Hypo

SEQ ID NO: 123645 - DNA, 27 bp, Homo sapiens
  chr4:103811714-103811741
  Hypo
ggcttggtgcagtgacgacacacctgt

SEQ ID NO: 123646 - DNA, 30 bp, Homo sapiens; identical to SEQ ID NO: 91420
  chr4:103941455-103941485
  Hypo

SEQ ID NO: 123647 - DNA, 298 bp, Homo sapiens; identical to SEQ ID NO: 91421
  chr4:103997871-103998169
  Hyper

SEQ ID NO: 123648 - DNA, 30 bp, Homo sapiens; identical to SEQ ID NO: 91422
  chr4:104073705-104073735
  Hypo

SEQ ID NO: 123649 - DNA, 30 bp, Homo sapiens; identical to SEQ ID NO: 91429
  chr4:106046597-106046627
  Hypo

SEQ ID NO: 123650 - DNA, 147 bp, Homo sapiens; identical to SEQ ID NO: 91430
  chr4:106067073-106067220
  Hyper

SEQ ID NO: 123651 - DNA, 15 bp, Homo sapiens
  chr4:106689465-106689480
  Hypo
cgtaagtcatcgcgc

SEQ ID NO: 123652 - DNA, 47 bp, Homo sapiens; identical to SEQ ID NO: 91432
  chr4:106816754-106816801
  Hyper

SEQ ID NO: 123653 - DNA, 30 bp, Homo sapiens; identical to SEQ ID NO: 40328
  chr4:107134495-107134525
  Hypo

SEQ ID NO: 123654 - DNA, 668 bp, Homo sapiens; identical to SEQ ID NO: 91435
  chr4:107955181-107955849
  Hyper

SEQ ID NO: 123655 - DNA, 1579 bp, Homo sapiens
  chr4:107956414-107957993
  Hyper
ctgtatctggggccacgctccgaatgttgcaagatgcaatggcaaaccgctagcccaagagagctggcccctgcctcttctgtctgaagaatgtgtttgggggttttcctacctgccccaggtttttgcccttcttactgccgccgaatgccagtccttggtacatgcccgcagatcgattggcggcctgaccaggcgtctccccgcccagagaggacttgatggagttgagtttggcccgcgaactgccgatctgtgagctctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtgacccaaggtgcaagaaaacccagccctgtggatcgcaccgcttccgttccttcttgccccgcacctccttggtcccgccgggatctcggcggtttaactctcctcttaattgatcaggaggcccgcatcagctccttctccttcaactcagttgcttttctctcctctcttttcctatcctttatgtgtcaaactttgcaggacacagtgctccttttcaaagttagcaggcgctttagtaggggatcaggagacgtccccggaccgaatcctcgagatctgaagagaatcgaggtcccccacacgcgcactcacagttgccccgaagcgttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaagagtgacaaagagtgaaaatttttctctcactccccaccgcttccgcccccctcctctctgcgtgctgcttctgcttctgcggctttcactccagcttttcctcctcctcatcctcccgctctgtctccacccacaactactggaaaagggggatctagcttttccatgaggtgaatggaacataggggctcctaattcctgacaacaactccagcggttggaggggtctttggaaactggcagagaccaaaggtggaaacggagtggggcaagctgacaccacttgatcgctgccaccctttcttagatcttcccacccatcttcagcccctgactccgcgaggagagctggaaaagccctatggaagctttagagaagtgagcatctgcgcatctgctcattagtattgtgttctttgtgagctcacgtttggttttagac

SEQ ID NO: 123656 - DNA, 247 bp, Homo sapiens; identical to SEQ ID NO: 91438
  chr4:107958393-107958640
  Hyper

SEQ ID NO: 123657 - DNA, 33 bp, Homo sapiens; identical to SEQ ID NO: 91439
  chr4:107994285-107994318
  Hypo

SEQ ID NO: 123658 - DNA, 30 bp, Homo sapiens; identical to SEQ ID NO: 91440
  chr4:108044889-108044919
  Hypo

SEQ ID NO: 123659 - DNA, 200 bp, Homo sapiens; identical to SEQ ID NO: 91441
  chr4:108302104-108302304
  Hypo

SEQ ID NO: 123660 - DNA, 30 bp, Homo sapiens; identical to SEQ ID NO: 91442
  chr4:108745720-108745750
  Hyper

SEQ ID NO: 123661 - DNA, 57 bp, Homo sapiens; identical to SEQ ID NO: 91443
  chr4:108746014-108746071
  Hyper

SEQ ID NO: 123662 - DNA, 128 bp, Homo sapiens; identical to SEQ ID NO: 91444
  chr4:108746391-108746519
  Hyper

SEQ ID NO: 123663 - DNA, 111 bp, Homo sapiens; identical to SEQ ID NO: 91445
  chr4:108853176-108853287
  Hyper

SEQ ID NO: 123664 - DNA, 473 bp, Homo sapiens; identical to SEQ ID NO: 91446
  chr4:109087990-109088463
  Hyper

SEQ ID NO: 123665 - DNA, 645 bp, Homo sapiens; identical to SEQ ID NO: 91447
  chr4:109088669-109089314
  Hyper

SEQ ID NO: 123666 - DNA, 50 bp, Homo sapiens; identical to SEQ ID NO: 91448
  chr4:109090370-109090420
  Hyper

SEQ ID NO: 123667 - DNA, 122 bp, Homo sapiens; identical to SEQ ID NO: 29069
  chr4:109092563-109092685
  Hyper

SEQ ID NO: 123668 - DNA, 1182 bp, Homo sapiens; identical to SEQ ID NO: 91450
  chr4:109093101-109094283
  Hyper

SEQ ID NO: 123669 - DNA, 55 bp, Homo sapiens; identical to SEQ ID NO: 29071
  chr4:109094529-109094584
  Hyper

SEQ ID NO: 123670 - DNA, 184 bp, Homo sapiens; identical to SEQ ID NO: 91452
  chr4:109183797-109183981
  Hypo

SEQ ID NO: 123671 - DNA, 16 bp, Homo sapiens
  chr4:109311251-109311267
  Hypo
aataaaaacagccaac

SEQ ID NO: 123672 - DNA, 506 bp, Homo sapiens; identical to SEQ ID NO: 91455
  chr4:109683609-109684115
  Hyper

SEQ ID NO: 123673 - DNA, 1479 bp, Homo sapiens
  chr4:110222955-110224434
  Hyper
aaggggcccctttggcggattcgagagcggcgatcctcgcctggaggtcgttggttttcacacccaggtacaggcaagacaccacggccaccactgacaggagggccgccaggacggcacacgggggcatggtccgggcacaatgctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtggcggtggggtaaaaagcaagacgaaacccacccagacagctcttccgactcccagaggaccgacacctctttcgagggccccaacagtggccgctcagggtccgagggcaacggccgaggcgccacgcggggccgcggctcgccctggccacggaggaccggacctgttgcgcctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaatacccttcgcgatgctcgcgtgagtgtgtgtgtgagtgtgtgagtgcgcgcgcgctccgagcacgacgtccctcccccgaccccctcccggcgcccggcgtccggcctgccgctcccgctgctgcgcgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatctctactgatcttcactcaaaagcagccgcaggagctgttgctatctcgctgtggtgcagcgcttttccctcctc

SEQ ID NO: 123674 - DNA, 79 bp, Homo sapiens; identical to SEQ ID NO: 40332
  chr4:110735440-110735519
  Hypo

SEQ ID NO: 123675 - DNA, 19 bp, Homo sapiens
  chr4:110735819-110735838
  Hypo
gccccgcctacaaaggtat

SEQ ID NO: 123676 - DNA, 30 bp, Homo sapiens; identical to SEQ ID NO: 91462
  chr4:111215543-111215573
  Hypo

SEQ ID NO: 123677 - DNA, 136 bp, Homo sapiens
  chr4:111531853-111531989
  Hyper
agcctaggacttcagcgcgacctcaagccaggacttctgcgaggtctcaggtccgagggccaggtcgggcgccggttgcaccgcccaccgcgcgcctccccttcgtccccaggccctggtccggggctcttgctgc

SEQ ID NO: 123678 - DNA, 1115 bp, Homo sapiens
  chr4:111532245-111533360
  Hyper
ccctcatttgtcctccgcttcctgcggctgaacggtccttgataagtggcctccagaagattcggtactttgggccaggggcaaggctggggctgctctaggtgcagaactctctataggtcctctctcccaggaccggatagatgattcatttttatacgtaacgttttaccccagtctattcccgcagctggttaatgttcaacccccgggcctcgagaggcagctccaaggaggcaggcaggcatgacccattcaaggtatatggctgctcgggagtgaaggcgcggaggcccgagaaagggtgagaagggatgtggcggggggctcctccggccctggactccctgggtggactagaaaagggcaaagaagtggtcacatctgtgggccagactggtgcgcgatctttggaggcgcagcagcaaggccgcgccagggctgagcccagaccgcccacgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgcctctgaaaataccgtcagggtaaagggagacaggcagtaagtcttaccaccaccgccctttccccatgtcattggccaaaaactgaacattaagataaagcagctgtttcagtcaatggaaagcggtagggcgaggttgtacccaaaacccggtttagacggccaatgaagtcctaggaaaagccgccccgggggcacgttcaggtggagcggctgcacctcgggtcgttctaagggatgggctgcgtggtacccacggaattcatgggtccaaaaggtcctggtcacctgtccaaacatccatcccctggcgcatggcggttgacaagatggcccggccacccagagga

SEQ ID NO: 123679 - DNA, 44 bp, Homo sapiens
  chr4:111535304-111535348
  Hyper
ttcttcagtcaaccacgtttcttgcttcccggtgtgcttagatt

SEQ ID NO: 123680 - DNA, 30 bp, Homo sapiens
  chr4:111535679-111535709
  Hyper
cagggttaatttatacggctttcgaggaat

SEQ ID NO: 123681 - DNA, 1151 bp, Homo sapiens
  chr4:111536093-111537244
  Hyper
taataaaacaaaacccgaggataggccaaagataccgagagaagaaaaggtgcctgctagtaacaggtgagggatggaagggggtggcggggagaaagcccccagacggcggatcgtctgcgcggggttcctgccccaggcctggcgaacctctgagcgctcaaggagcacggcggcagtgcgctgaggccagtgaggcctgggcgcctccgggcccaacctcgagctcgccatttttgaacccaagcggggaaggttggtgctcatgctatagattatgttaaaggttcctttaagcactttaatacacaactagctcagaaatcattaagagacctagagaaggagaaaaaataccctcacactcaccggtaataagtgttgacatgcagcaaaaatcggttgagtggaaccgaggtggtggttgcagcgacggctagagggggacccgtgcaggggcgggaggggcgaggggactgactgcaccggctctgggagctaggtttctctcgctggatgggaaaaggaggtgcggaaaggggcaggcggcctgcgggctagcggggatgagagttgtggggagaacggaggagagagtaaaattattccttttggaagtccaagggaagggagctgaggtgagagaaatggcctctcttaggtcccaagtctccgcccccagcctgcaccactcaagtcggggaagtgacaactcttcctaaacctcgacttccattttttgtttcctgcagattgattgatgtcctcgcgttgttctagttcagcaaccaaactaggccgaggtacacctcttttacccagagctcccaaatcactcaccaacctgcaggagacctaaatcctccgggcaggtctcgttagcgcttccagcccccatccccaaatcccctcttctagctccttccttcccctccgccctttggccctccccgccccctaccaggctgagaggcggagaggccgggaccgctgggccctgcggctccagaagccaaagtccgcccgtggggaccgttttcctctccactgctctcaagtgaacaacatggtgggaggtgaccctcgtccaaagggcttttatctgccccccactgctgcgtgatccctccgcaagtcggaggcagagcttt

SEQ ID NO: 123682 - DNA, 45 bp, Homo sapiens; identical to SEQ ID NO: 91472
  chr4:111537452-111537497
  Hyper

SEQ ID NO: 123683 - DNA, 132 bp, Homo sapiens
  chr4:111539463-111539595
  Hyper
caccgcggaattcagcgacgggctactcaggttgttcaagttattcaggctgttgagactggagcccgggacgcctgtcactgctgagggcaccatgctggacgacatgctcatggacgagatagagttggg

SEQ ID NO: 123684 - DNA, 57 bp, Homo sapiens; identical to SEQ ID NO: 91474
  chr4:111539809-111539866
  Hyper

SEQ ID NO: 123685 - DNA, 632 bp, Homo sapiens
  chr4:111540088-111540720
  Hyper
gccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtatt

SEQ ID NO: 123686 - DNA, 286 bp, Homo sapiens
  chr4:111542187-111542473
  Hyper
gcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagac

SEQ ID NO: 123687 - DNA, 915 bp, Homo sapiens
  chr4:111542809-111543724
  Hyper
atttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgct

SEQ ID NO: 123688 - DNA, 740 bp, Homo sapiens
  chr4:111543967-111544707
  Hyper
aataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaacta

SEQ ID NO: 123689 - DNA, 1098 bp, Homo sapiens; identical to SEQ ID NO: 91481
  chr4:111549751-111550849
  Hyper

SEQ ID NO: 123690 - DNA, 139 bp, Homo sapiens; identical to SEQ ID NO: 91482
  chr4:111552072-111552211
  Hyper

SEQ ID NO: 123691 - DNA, 60 bp, Homo sapiens; identical to SEQ ID NO: 91483
  chr4:111552448-111552508
  Hyper

SEQ ID NO: 123692 - DNA, 1225 bp, Homo sapiens; identical to SEQ ID NO: 91484
  chr4:111552914-111554139
  Hyper

SEQ ID NO: 123693 - DNA, 30 bp, Homo sapiens; identical to SEQ ID NO: 91485
  chr4:111554631-111554661
  Hyper

SEQ ID NO: 123694 - DNA, 846 bp, Homo sapiens
  chr4:111554950-111555796
  Hyper
tccccctttctctcccgggcgagccaaatctttttcacgttttcaaccacaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 123695 - DNA, 1623 bp, Homo sapiens
  chr4:111557628-111559251
  Hyper
tgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 123696 - DNA, 556 bp, Homo sapiens; identical to SEQ ID NO: 91490
  chr4:111560186-111560742
  Hyper

SEQ ID NO: 123697 - DNA, 348 bp, Homo sapiens
  chr4:111562342-111562690
  Hyper
aacagaccaatatctcgcactcaaaacggagtttccggtgattcccagctttaattttggagcaggggtctttctcctctgctgttaaaaagattttgtgcttgtttgtgagtgagtgcattcaagtggaaggaacgctcccacggctacggtggctcaggccctttgctcggaccgggaccttacagttctaacccaggagcgttaaactctggaagactccgggccagccctggaggtgcgtggccccgcaagtcgccaggccaagcttgctttttctgtctgcccctccggcaggctgggcgcgctatggcagtgagctttccgcgcaaacggagagctggaacc

SEQ ID NO: 123698 - DNA, 30 bp, Homo sapiens; identical to SEQ ID NO: 91493
  chr4:112059654-112059684
  Hypo

SEQ ID NO: 123699 - DNA, 209 bp, Homo sapiens; identical to SEQ ID NO: 91494
  chr4:112244823-112245032
  Hypo

SEQ ID NO: 123700 - DNA, 198 bp, Homo sapiens; identical to SEQ ID NO: 91495
  chr4:113154853-113155051
  Hypo

SEQ ID NO: 123701 - DNA, 164 bp, Homo sapiens; identical to SEQ ID NO: 91496
  chr4:113199029-113199193
  Hypo

SEQ ID NO: 123702 - DNA, 539 bp, Homo sapiens; identical to SEQ ID NO: 91497
  chr4:113430619-113431158
  Hyper

SEQ ID NO: 123703 - DNA, 886 bp, Homo sapiens
  chr4:113431723-113432609
  Hyper
cccaggctgggggagcgagaaaggggggtattggagccctcacgttttattggtctaacctaatttcactaattctcttttcacacatttcttttgcagattcggaggccgggactttcacgctcccgggagcgcactgcattggcgcgattcaagagctgcccgctttatttaattaatacattcaaagctcgcttgggagcccgagggggctcggggaagaccgaggctggcggtgaggaggaggcgcttttaaccggttccaggtgtcggtgcccagaagtcacaaccagctcaagggtgtgcaatgcaggggggtgtacccagcgggtgggggcgccgcagctcccagcctcgccctcaagcccggccctttagcagcctgtgacccagactggcgggtgggcagctgaagccggccttgggtctaaacgcccttcctgggccatcggactaggctttgggaagtgccgaatgggtccttcctccctcctggccaaagccgcccagggccttcgcctcagctgggacaccaggagcgcccatccggctctggtccaggtgctgcgggcccgggaagcctcagcccctcctcctgcctccggctgagcctaggtccggctcccgtggcgggcccagcggttggcagtccgcctctctactttttttttcctccttcttggcactcagatggatgtatttaaaatctagtgaaggaaaaatgagccgtaacaaggcctgagcactttagaacaaataaatacagccagtcccggaacgccggccgcgctaaagcgacgctccaatgagaacaggacccaccttcgcgcctctccgcacttaggaaaacgcgccgcagcgcgctagctggcgttggaaagatcta

SEQ ID NO: 123704 - DNA, 33 bp, Homo sapiens; identical to SEQ ID NO: 91502
  chr4:113435442-113435475
  Hyper

SEQ ID NO: 123705 - DNA, 811 bp, Homo sapiens; identical to SEQ ID NO: 91503
  chr4:113435774-113436585
  Hyper

SEQ ID NO: 123706 - DNA, 488 bp, Homo sapiens; identical to SEQ ID NO: 91504
  chr4:113436827-113437315
  Hyper

SEQ ID NO: 123707 - DNA, 656 bp, Homo sapiens; identical to SEQ ID NO: 91505
  chr4:113437622-113438278
  Hyper

SEQ ID NO: 123708 - DNA, 198 bp, Homo sapiens; identical to SEQ ID NO: 7510
  chr4:113438506-113438704
  Hyper

SEQ ID NO: 123709 - DNA, 1028 bp, Homo sapiens
  chr4:113441524-113442552
  Hyper
attccctccacacttcgacctcacaagttgcgaaagaggacaaatggtcgccgcgctagtcccttgctgttgcaggtgactgtcgggggcgcgaaagagggcgcccttccctgagaggacaaaagccaaggtttggctatccagcgagcctgtcccccaattcacagtaaaccaccgtcggccaaaggagatggcgtgtctactctctgctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcccggccaggtcactgaactgcgcttcactgcgccagcccctccccttcagtattttcatcgcgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatccccacctgctctggggaaggcaaagctccgcagacttcttatccctgaggcaacccgctacccaaatgtc

SEQ ID NO: 123710 - DNA, 178 bp, Homo sapiens; identical to SEQ ID NO: 91509
  chr4:113442754-113442932
  Hyper

SEQ ID NO: 123711 - DNA, 446 bp, Homo sapiens
  chr4:113444002-113444448
  Hyper
gaaaaaaattgttttatatatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataacgcagttgctagtacagctctcggcggaggagccagggccgggtctccaggccgggagggggcggccgcggtgcgcccgggcagcgctccctgcgcaagtagttcttctatgtctttacacgcacttccaaaaaaacttcgcaagtcacagaaa

SEQ ID NO: 123712 - DNA, 500 bp, Homo sapiens; identical to SEQ ID NO: 29125
  chr4:113444944-113445444
  Hyper

SEQ ID NO: 123713 - DNA, 41 bp, Homo sapiens; identical to SEQ ID NO: 91513
  chr4:113559124-113559165
  Hypo

SEQ ID NO: 123714 - DNA, 101 bp, Homo sapiens; identical to SEQ ID NO: 91514
  chr4:113559405-113559506
  Hypo

SEQ ID NO: 123715 - DNA, 30 bp, Homo sapiens; identical to SEQ ID NO: 91515
  chr4:113626216-113626246
  Hyper

SEQ ID NO: 123716 - DNA, 469 bp, Homo sapiens; identical to SEQ ID NO: 91516
  chr4:113626447-113626916
  Hyper

SEQ ID NO: 123717 - DNA, 97 bp, Homo sapiens; identical to SEQ ID NO: 91517
  chr4:113627374-113627471
  Hyper

SEQ ID NO: 123718 - DNA, 30 bp, Homo sapiens; identical to SEQ ID NO: 40338
  chr4:114176916-114176946
  Hypo

SEQ ID NO: 123719 - DNA, 64 bp, Homo sapiens; identical to SEQ ID NO: 29128
  chr4:114900586-114900650
  Hyper

SEQ ID NO: 123720 - DNA, 373 bp, Homo sapiens; identical to SEQ ID NO: 91523
  chr4:115519455-115519828
  Hyper

SEQ ID NO: 123721 - DNA, 94 bp, Homo sapiens; identical to SEQ ID NO: 91524
  chr4:115520056-115520150
  Hyper

SEQ ID NO: 123722 - DNA, 571 bp, Homo sapiens; identical to SEQ ID NO: 91525
  chr4:115520374-115520945
  Hyper

SEQ ID NO: 123723 - DNA, 25 bp, Homo sapiens
  chr4:116217409-116217434
  Hypo
cccaaagtgccgggattataagctt

SEQ ID NO: 123724 - DNA, 19 bp, Homo sapiens
  chr4:117179151-117179170
  Hypo
ctcacgctgggagctgtag

SEQ ID NO: 123725 - DNA, 279 bp, Homo sapiens
  chr4:117847229-117847508
  Hyper
tccccagggcggccccgcgtccgggcggctctctgaggctacgcggtgcccggtgtccggcggggacgactagcgggcgacccctcccatctcgctccccacatccccgcggacacagctggtggcgactcagacctctcgggcagcggctgcagggcgagcacagaggggactccgatgcgaaccgaggccccgggacccgccaggccacccgcgccgccgcccctctccgggtacgcgcgggcccgctcgtcctgggactaacgaagcaaaggcggg

SEQ ID NO: 123726 - DNA, 80 bp, Homo sapiens; identical to SEQ ID NO: 91535
  chr4:118954370-118954450
  Hyper

SEQ ID NO: 123727 - DNA, 120 bp, Homo sapiens; identical to SEQ ID NO: 91536
  chr4:118955005-118955125
  Hyper

SEQ ID NO: 123728 - DNA, 61 bp, Homo sapiens; identical to SEQ ID NO: 91537
  chr4:118955468-118955529
  Hyper

SEQ ID NO: 123729 - DNA, 71 bp, Homo sapiens; identical to SEQ ID NO: 91538
  chr4:119273444-119273515
  Hyper

SEQ ID NO: 123730 - DNA, 166 bp, Homo sapiens; identical to SEQ ID NO: 91539
  chr4:119273737-119273903
  Hyper

SEQ ID NO: 123731 - DNA, 110 bp, Homo sapiens; identical to SEQ ID NO: 91540
  chr4:119274104-119274214
  Hyper

SEQ ID NO: 123732 - DNA, 147 bp, Homo sapiens; identical to SEQ ID NO: 91541
  chr4:119483379-119483526
  Hypo

SEQ ID NO: 123733 - DNA, 157 bp, Homo sapiens; identical to SEQ ID NO: 91544
  chr4:121843147-121843304
  Hyper

SEQ ID NO: 123734 - DNA, 167 bp, Homo sapiens; identical to SEQ ID NO: 91545
  chr4:121843564-121843731
  Hyper

SEQ ID NO: 123735 - DNA, 199 bp, Homo sapiens; identical to SEQ ID NO: 29138
  chr4:121844007-121844206
  Hyper

SEQ ID NO: 123736 - DNA, 30 bp, Homo sapiens; identical to SEQ ID NO: 91547
  chr4:121844427-121844457
  Hyper

SEQ ID NO: 123737 - DNA, 648 bp, Homo sapiens; identical to SEQ ID NO: 91548
  chr4:121992048-121992696
  Hyper

SEQ ID NO: 123738 - DNA, 524 bp, Homo sapiens; identical to SEQ ID NO: 91549
  chr4:121993212-121993736
  Hyper

SEQ ID NO: 123739 - DNA, 359 bp, Homo sapiens; identical to SEQ ID NO: 91550
  chr4:121993995-121994354
  Hyper

SEQ ID NO: 123740 - DNA, 21 bp, Homo sapiens
  chr4:122144242-122144263
  Hypo
agccaccgcgcccagccaggt

SEQ ID NO: 123741 - DNA, 923 bp, Homo sapiens
  chr4:122301422-122302345
  Hyper
ttaagagagaaggagcgaaggagcggggcgcgactcttaccccccagccagttgtcggaaatgttctggagcatggtgacgggaatgcagaagaaggtgatgagcaggtcactgagcgccaaggagcagataaagatgttggtgacggtgcgcatggccttgctgcgggtcaccacgtagaacaccagagcattgccaaagagcgccagggcgaagatgagcacgccggtgagcacgagggccagcttggcgcgtcccggcagctctggggtgtagacgagcggtcgcagccggtacagagcgatgaactgctcccgcgtcaggttgtggtcccgcagcagccgagagaactgctccggggtaatgttaagcgcctgcattgctgtgcgctcccgggacgcggggccaccgcccgctactggctggccatccgcatctgcggggcagcgagggcttcgggggaccagccggaggccgcctcccttcctctactctggagtcagccgcgcgggagggctctaggctgcaccccgggaggttcgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctggggtgctggagcgccacgcgagggtcctggcgcctctggctccccgccttctggccatgcgatgcggacgccggacccgcttggggagcggtggagggtggggctgaactcggtgacgcctccctcacacccagcttcagtggcgccaacgccgcttccccgcaccctcagggcgagggaagacttccctggctcaccaacttgctgccgcccagcgcctttctcagggc

SEQ ID NO: 123742 - DNA, 867 bp, Homo sapiens
  chr4:122685819-122686686
  Hyper
tctcgaagagcacagcgccagcccagaccccatacacccaccgtccctggcacccgaacgcgctgcgagccccgggcctcccacaggagcggagacgcgggtccctgcgcctcacgccggaacggacccgtcagagccgccgagccccgcacctggaagctgggaggccgcgaggacggagaatcgaggcggagacccagcccagcgcccgcgcagctcggtgccctcccgccagtgcccgcactcgggtcacaccgcttgctctcgggagaagccccaaggctcgcggtgcaccgagaggcgcccgggctggagcgccccggccgtgttggccacggagttcttcagctgcttgatgaccacgaagagcaggaggaaaagtaagaagagcaggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatccggcgcagactctcccagctggcaccaaagccttccgcttcgccgagatcctctcaggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaattaatt

SEQ ID NO: 123743 - DNA, 2006 bp, Homo sapiens; identical to SEQ ID NO: 91557
  chr4:122871189-122873195
  Hyper

SEQ ID NO: 123744 - DNA, 30 bp, Homo sapiens; identical to SEQ ID NO: 91558
  chr4:123505042-123505072
  Hypo

SEQ ID NO: 123745 - DNA, 30 bp, Homo sapiens; identical to SEQ ID NO: 91559
  chr4:123591397-123591427
  Hypo

SEQ ID NO: 123746 - DNA, 69 bp, Homo sapiens; identical to SEQ ID NO: 91560
  chr4:123664094-123664163
  Hypo

SEQ ID NO: 123747 - DNA, 1268 bp, Homo sapiens; identical to SEQ ID NO: 91561
  chr4:123747725-123748993
  Hyper

SEQ ID NO: 123748 - DNA, 137 bp, Homo sapiens; identical to SEQ ID NO: 91562
  chr4:123866916-123867053
  Hypo

SEQ ID NO: 123749 - DNA, 154 bp, Homo sapiens; identical to SEQ ID NO: 91563
  chr4:124320676-124320830
  Hyper

SEQ ID NO: 123750 - DNA, 17 bp, Homo sapiens
  chr4:124335280-124335297
  Hypo
acaatgtttgcaggccg

SEQ ID NO: 123751 - DNA, 185 bp, Homo sapiens; identical to SEQ ID NO: 91565
  chr4:124426676-124426861
  Hyper

SEQ ID NO: 123752 - DNA, 67 bp, Homo sapiens; identical to SEQ ID NO: 91566
  chr4:124427070-124427137
  Hyper

SEQ ID NO: 123753 - DNA, 67 bp, Homo sapiens; identical to SEQ ID NO: 91568
  chr4:125633717-125633784
  Hyper

SEQ ID NO: 123754 - DNA, 291 bp, Homo sapiens; identical to SEQ ID NO: 91569
  chr4:126235709-126236000
  Hyper

SEQ ID NO: 123755 - DNA, 210 bp, Homo sapiens; identical to SEQ ID NO: 91570
  chr4:126236242-126236452
  Hyper

SEQ ID NO: 123756 - DNA, 346 bp, Homo sapiens; identical to SEQ ID NO: 91571
  chr4:126236714-126237060
  Hyper

SEQ ID NO: 123757 - DNA, 32 bp, Homo sapiens; identical to SEQ ID NO: 29153
  chr4:126237355-126237387
  Hyper

SEQ ID NO: 123758 - DNA, 754 bp, Homo sapiens; identical to SEQ ID NO: 91573
  chr4:126237654-126238408
  Hyper

SEQ ID NO: 123759 - DNA, 30 bp, Homo sapiens; identical to SEQ ID NO: 91574
  chr4:126444051-126444081
  Hypo

SEQ ID NO: 123760 - DNA, 30 bp, Homo sapiens; identical to SEQ ID NO: 91575
  chr4:127173962-127173992
  Hypo

SEQ ID NO: 123761 - DNA, 31 bp, Homo sapiens; identical to SEQ ID NO: 91576
  chr4:127411324-127411355
  Hypo

SEQ ID NO: 123762 - DNA, 388 bp, Homo sapiens; identical to SEQ ID NO: 91578
  chr4:128544016-128544404
  Hyper

SEQ ID NO: 123763 - DNA, 160 bp, Homo sapiens; identical to SEQ ID NO: 29156
  chr4:128544646-128544806
  Hyper

SEQ ID NO: 123764 - DNA, 51 bp, Homo sapiens
  chr4:128554131-128554182
  Hyper
agcaagctatagctgcgagatttgaattactccactcgtagctattgcatt

SEQ ID NO: 123765 - DNA, 30 bp, Homo sapiens; identical to SEQ ID NO: 91580
  chr4:128801420-128801450
  Hypo

SEQ ID NO: 123766 - DNA, 76 bp, Homo sapiens; identical to SEQ ID NO: 91581
  chr4:128887678-128887754
  Hypo

SEQ ID NO: 123767 - DNA, 37 bp, Homo sapiens; identical to SEQ ID NO: 91582
  chr4:128889082-128889119
  Hypo

SEQ ID NO: 123768 - DNA, 100 bp, Homo sapiens; identical to SEQ ID NO: 40341
  chr4:128984233-128984333
  Hypo

SEQ ID NO: 123769 - DNA, 40 bp, Homo sapiens; identical to SEQ ID NO: 91585
  chr4:129233933-129233973
  Hypo

SEQ ID NO: 123770 - DNA, 30 bp, Homo sapiens; identical to SEQ ID NO: 91586
  chr4:129729959-129729989
  Hypo

SEQ ID NO: 123771 - DNA, 30 bp, Homo sapiens; identical to SEQ ID NO: 91588
  chr4:130931683-130931713
  Hypo

SEQ ID NO: 123772 - DNA, 20 bp, Homo sapiens
  chr4:131702671-131702691
  Hypo
taccgcgcctggccattttt

SEQ ID NO: 123773 - DNA, 30 bp, Homo sapiens; identical to SEQ ID NO: 91590
  chr4:133093073-133093103
  Hypo

SEQ ID NO: 123774 - DNA, 227 bp, Homo sapiens; identical to SEQ ID NO: 29157
  chr4:134067790-134068017
  Hyper

SEQ ID NO: 123775 - DNA, 649 bp, Homo sapiens
  chr4:134068272-134068921
  Hyper
tcccacatgcaaacacgcgcgcactcgcgcgcacacacacaagtgtttccatacgtacaaatgaacgcattagaaaattaccgtcattttttaaaaggctccaggattctgacgagtcagcttgaagagctcaaaacatttcatttcaattctgcagatctgaagaaaaagaaaggggggaggggtggaagtacagatgcaataccgtattaatattcagatacactataatctccttttcattgatccacaggtccctttatacactgccgctccattctcagccgcagacgtgatgctaaaatcattttaactgcagcggttttcgcttggctttggccagtcttcaatttactgcagctggaaaaggattagccatttttgctggaatcctttccttctaagcgctcaaaggcaggacccatcttcatgaaagagccaagtgcgggggccggggggacccggcgttgcggggagttggggcgcggaaatcagggcagtagacgtgcattcgcgggactctcagaagcacgtctcaggctactatcacgcccatggacactagccctccttaactccttgccaggaggaaatggcaacgtatctccaggtcggaaaacgactctacttttcccgcaggttgtggtgg

SEQ ID NO: 123776 - DNA, 592 bp, Homo sapiens; identical to SEQ ID NO: 91600
  chr4:134069304-134069896
  Hyper

SEQ ID NO: 123777 - DNA, 262 bp, Homo sapiens
  chr4:134070193-134070455
  Hyper
ggactgggaactttccgcggcattgtccccagccagcgcctcgggacctgcggggctgttctcgctctcacactcacactcaccccggccgctcgggcgagagttctgtcccgccccgcccggctgccgcgtgacgtgtctgtttggcggccagtttggccaatcatcggcagctcggtgggtggtgctcctgggcgattggttggcagaatgagggcgctgcgcaaaaacggagaagccgagcgctcggagctcagaaact

SEQ ID NO: 123778 - DNA, 2653 bp, Homo sapiens
  chr4:134071052-134073705
  Hyper
gatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccga

SEQ ID NO: 123779 - DNA, 126 bp, Homo sapiens; identical to SEQ ID NO: 29167
  chr4:134074030-134074156
  Hyper

SEQ ID NO: 123780 - DNA, 30 bp, Homo sapiens; identical to SEQ ID NO: 91609
  chr4:135248649-135248679
  Hypo

SEQ ID NO: 123781 - DNA, 30 bp, Homo sapiens; identical to SEQ ID NO: 40342
  chr4:136320705-136320735
  Hypo

SEQ ID NO: 123782 - DNA, 140 bp, Homo sapiens; identical to SEQ ID NO: 91630
  chr4:138453793-138453933
  Hyper

SEQ ID NO: 123783 - DNA, 47 bp, Homo sapiens; identical to SEQ ID NO: 91638
  chr4:139952127-139952174
  Hyper

SEQ ID NO: 123784 - DNA, 28 bp, Homo sapiens
  chr4:140100690-140100718
  Hypo
tgggcaacgagagcgaaactccgtctca

SEQ ID NO: 123785 - DNA, 1165 bp, Homo sapiens
  chr4:140200429-140201594
  Hyper
gctttcctatatgtccgtttttatttaataagcctccagttcacactgcaactccccctttagttaattgctgagtattctgctttttctcgcgtatcctcagaaccaaaggtgtcgatatttggactacagagccaagcagttgcaggacgacgtgcaacctcaaaggaaagtgtcccgaaggccgcttcctttttgggggttgtggatctcagagccaggcgctcgcggggttcaggctgctgagaccctgccaagggttaggtttatttaccccacgaacattcgcccagcgtccactgagcgggccctgcctcactgcctcccagcgcttgccgggcccgctcgctgatcggcgtccaccttcccaccgttcctctgcttcctcaggagattggagagcgaatggtgcctctaacaataaaagtggtaagctgcgactttgtcagccaggcacgtttttaagtgcttttaaccatacattaactcattaaaaaggaaaaccatcatcgccctcattttatagatgaggaaacaggttaagccatttgtccaagatcaggatgcgaacccagataatctggactctgaggcaccctggaaaagttccctacttccaaagtctgcaggagcttcgggacgtcttcccgggagtctcccccagtctcctcgacctccaatccaggcttctgctgctctgggtcgggtttggccaactgggtgccggccggttccctggcgcgggcgaaatctgcacccgaggcgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggagacctttgtagtcctcaccatcctcccctaacccatctccagctctgttgctatccctgaggtctctagagctgaccgcggcatctcagaaaagggatggggaacctacaagtcgccgtcgcctgcctggctca

SEQ ID NO: 123786 - DNA, 39 bp, Homo sapiens; identical to SEQ ID NO: 91649
  chr4:140566713-140566752
  Hypo

SEQ ID NO: 123787 - DNA, 1305 bp, Homo sapiens
  chr4:140655870-140657175
  Hyper
atttataaatctgtgcgtagggaagctttatttttctgaagtgttttcaagaacatgcatagtgtttgggtgagaggggccagccttgctggcggcgaaccaaagagcagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcgccccctcccctcgcagatggcttaatcagggctcccgcccgcccctccgcggcccccgccccgcgcgtctgggcgagcgctgcgaacgtggagccaggcagtcaagtgttactgcgtacagcaggtagcctggcaactgagagcacaataccgagcagatggtgttcgcacggcgtgatggacatcacacacgacagcctgagacaatccaggaattccctggtgactcgaggccctctttgcacaaaatgagttctctctccattgccgtgtatctctggggttatctgcccccctcctccgactgacactgaactggtttctcattaccgacttttcttccagccggaggggaggaagaattcaagtgggggagggcgcgggaaggggacgtggagggaaacggaagggctgggagtggggtaggggggcagtggcgacctccggggggggagggtggcggacaccagaccccagggccgacagcccgggagggaccgggttccaggaccccagctgcacaaagccggcccggggagggggcgataaggagcgagcctcgggtcggcccggcaccgctgcttcggctcagagtccttgcaatcgcttggcctacgaacaacctaaatgaaatttagggttttattgaaaaagtcccctggggcctaatttagcctctcgactccagcctatatgcttacaagtcctcaggggactccggctaggaagtcaggagtggggcccgtgcgtccccggcaggacctagactgcctctcggcgcaggcggccctaacaaagaagcccacgaggcggtcccgggcgcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcgtgtgtgttagtggctgggaaggacacgaggacagagatga

SEQ ID NO: 123788 - DNA, 30 bp, Homo sapiens; identical to SEQ ID NO: 40344
  chr4:140753539-140753569
  Hypo

SEQ ID NO: 123789 - DNA, 139 bp, Homo sapiens; identical to SEQ ID NO: 91653
  chr4:140754226-140754365
  Hypo

SEQ ID NO: 123790 - DNA, 30 bp, Homo sapiens; identical to SEQ ID NO: 91656
  chr4:140970389-140970419
  Hyper

SEQ ID NO: 123791 - DNA, 321 bp, Homo sapiens; identical to SEQ ID NO: 91657
  chr4:141031289-141031610
  Hypo

SEQ ID NO: 123792 - DNA, 30 bp, Homo sapiens; identical to SEQ ID NO: 91658
  chr4:141272492-141272522
  Hypo

SEQ ID NO: 123793 - DNA, 102 bp, Homo sapiens; identical to SEQ ID NO: 91659
  chr4:141294316-141294418
  Hyper

SEQ ID NO: 123794 - DNA, 654 bp, Homo sapiens; identical to SEQ ID NO: 91660
  chr4:141294633-141295287
  Hyper

SEQ ID NO: 123795 - DNA, 813 bp, Homo sapiens; identical to SEQ ID NO: 91661
  chr4:141348027-141348840
  Hyper

SEQ ID NO: 123796 - DNA, 590 bp, Homo sapiens; identical to SEQ ID NO: 29176
  chr4:141418867-141419457
  Hyper

SEQ ID NO: 123797 - DNA, 266 bp, Homo sapiens; identical to SEQ ID NO: 29177
  chr4:141488816-141489082
  Hyper

SEQ ID NO: 123798 - DNA, 598 bp, Homo sapiens; identical to SEQ ID NO: 91664
  chr4:141489783-141490381
  Hyper

SEQ ID NO: 123799 - DNA, 1363 bp, Homo sapiens
  chr4:142053231-142054594
  Hyper
gaacccctgtccaagcggcgctatgccaagctctccggcagcctctcccctacccaatacagttaatcttctcctctttgtaaaccccccaagtgacgcggagcaaaacttaatcggtccagggaacccagacacgtcttccgcgccgcacggacttcccagaaggagcctggaggcaggcgctggatccctctaggcacctccgtccccgccggctcccctcccccgcgcccgctgggccactcacccgcgtggggcatggtgatggtctcgttggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgccgagcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcgga

SEQ ID NO: 123800 - DNA, 103 bp, Homo sapiens; identical to SEQ ID NO: 91667
  chr4:142054654-142054757
  Hyper

SEQ ID NO: 123801 - DNA, 30 bp, Homo sapiens; identical to SEQ ID NO: 91668
  chr4:142846491-142846521
  Hypo

SEQ ID NO: 123802 - DNA, 24 bp, Homo sapiens
  chr4:142846965-142846989
  Hypo
ccacccgcccggccacatttgtac

SEQ ID NO: 123803 - DNA, 604 bp, Homo sapiens
  chr4:143766796-143767400
  Hyper
aaaaaacaaggcaaccgggaccaccaacatcagtcaccctcactccccaccactgcctctattccttaaggacttcttcccaggccggcggcggcggcggcggcggcggcggcagcttgcgatcatcaggattggaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgctcggcgagagggtaggcgcggtgacaggggtaccccagcagccgaggagagacagcccaccccaccctttaagctaaagagctggaggggtgatggaggctgcaagacggagaaacttgatgcaaaacagacaggctcccccctccaagacgtgccgccacgctctcagacacgctccctcgcctcccggattacccaccatcaaccaccccaccctgcaaaattcccccaccgagccctaggatcccaggcgggtaattacctctcccggaggcggagtggggggcggcagcagcagcag

SEQ ID NO: 123804 - DNA, 653 bp, Homo sapiens; identical to SEQ ID NO: 91671
  chr4:143767625-143768278
  Hyper

SEQ ID NO: 123805 - DNA, 328 bp, Homo sapiens; identical to SEQ ID NO: 91672
  chr4:144100297-144100625
  Hypo

SEQ ID NO: 123806 - DNA, 31 bp, Homo sapiens; identical to SEQ ID NO: 91673
  chr4:144220336-144220367
  Hypo

SEQ ID NO: 123807 - DNA, 30 bp, Homo sapiens; identical to SEQ ID NO: 91674
  chr4:144265355-144265385
  Hypo

SEQ ID NO: 123808 - DNA, 29 bp, Homo sapiens
  chr4:144434031-144434060
  Hyper
catggtagtgtgcacgttatttgcttaac

SEQ ID NO: 123809 - DNA, 42 bp, Homo sapiens; identical to SEQ ID NO: 29183
  chr4:144480322-144480364
  Hyper

SEQ ID NO: 123810 - DNA, 1264 bp, Homo sapiens
  chr4:144620967-144622231
  Hyper
gcggaccagcacacccgcggacccagcgtcttggccctcaggccccagcagctccaccatcatgggcacgtagtcacggttgggcgaggaggtggctgtgtgctgatagcgcaccccagcacggaggaaagcctcacagtctacgcccttgcccctggggagaggggcccccaccgcgtccaccaagcgcccgtacttgggcagggggccgtcctcgtgaggaagtggggtaagccggcacctgcgggtggccgtggctccagacttcagggaggcgaagtccagcactctcctgtctatggcgcggctccagcttcgcagcttctccactaccaaaggcctgttacgcgtcaccagctccagctgggagaagaccaagtccaccgccagcgtgaagggcagcaccagagtgtgagtcggggcgtcgtagcgcagctgcagcagcacccgggcgcgtccggggctgtgggagccgaagtgagtgtactggacttggcggggcccgaaggtgcaggggaagcggcgcggggagagcgcgcccttgagccgcggcagggcgtccagtaccgtgacttcgcaccggtcccccggctgcactccaatcaccagatcccggagcgggtcgagccaaagggaacgacccaggggcacccggagtccagggttggcaatcagcacgctggggccgtcggggcgagtgccgtcaagcgcaccccgggcgggcaggtaaagcgccgggtcgggctcggtcccaagtgaggatgcccgtccctgcagcgcggggcgactcaagagcaggcaggcgagcgccacaaggagctgccggggcgtcccagtcgggtgccgagaagcccccgccatggccacggatggctcctggcgttgggattcccggggtggggtgccctgtgcaaagagggatctgctgagcggcaggtgcaggcagtggaagcagtagctgctgtccagtcggtagccgacttgcggatccagcaagagccagcggctgcgcttcggctgctgcaggtaacggcagcgggggaaggggctctgcccacttcctgctcagccccggtcgcaagtctctctctgctggcttctggggaccccagatacgcgcccagcgcggcgagacttagcgagggtgcagcgctgtcccctccgctcctgggcgcttcacccagcctaccttacacaccttctcgccgggagccgtggccgccgcactgctgcccgcgctgccagactccgaccagctgtctgg

SEQ ID NO: 123811 - DNA, 30 bp, Homo sapiens; identical to SEQ ID NO: 91679
  chr4:144742636-144742666
  Hypo

SEQ ID NO: 123812 - DNA, 85 bp, Homo sapiens; identical to SEQ ID NO: 91680
  chr4:144766556-144766641
  Hypo

SEQ ID NO: 123813 - DNA, 237 bp, Homo sapiens; identical to SEQ ID NO: 91681
  chr4:144785182-144785419
  Hypo

SEQ ID NO: 123814 - DNA, 18 bp, Homo sapiens
  chr4:144981012-144981030
  Hypo
gagcgagactctgtctca

SEQ ID NO: 123815 - DNA, 257 bp, Homo sapiens; identical to SEQ ID NO: 91683
  chr4:145567145-145567402
  Hyper

SEQ ID NO: 123816 - DNA, 1040 bp, Homo sapiens; identical to SEQ ID NO: 91684
  chr4:145567625-145568665
  Hyper

SEQ ID NO: 123817 - DNA, 23 bp, Homo sapiens
  chr4:145689704-145689727
  Hypo
tgctttcaagatggccgaatagg

SEQ ID NO: 123818 - DNA, 98 bp, Homo sapiens; identical to SEQ ID NO: 91686
  chr4:146853883-146853981
  Hypo

SEQ ID NO: 123819 - DNA, 32 bp, Homo sapiens; identical to SEQ ID NO: 40349
  chr4:147048518-147048550
  Hypo

SEQ ID NO: 123820 - DNA, 157 bp, Homo sapiens; identical to SEQ ID NO: 91688
  chr4:147554067-147554224
  Hyper

SEQ ID NO: 123821 - DNA, 643 bp, Homo sapiens
  chr4:147558009-147558652
  Hyper
agcacttacttgaaccgtccggcacaagccacattcattcacgtgaacactcccctttccctaccccatgtccaggtttcgctgagctcacacccggcaacactgctgctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggcggctcctgaggacagcggtcccatcttgaaaccgctattccgcccggctgaggtcaggggtggacaggcggtcccctactctccaccgccgcttccgggagctgaccacccgagggttccccttttccactctccttcccactctgtttttgtcccagcgcgcgccagcgcctctcaggcctgccgcctgctctcgcacctgctcgccttccccaggcgcccagtgcctgcacctgctcccggtcaacccccgtccggattgggccacccgcgggttcctgcgtcggggtcccggggccttctcaccctcgcctgcaccctgctccttccgctctctagggaggtgacagcagcccccaacaccgcgggaagtatagaga

SEQ ID NO: 123822 - DNA, 1378 bp, Homo sapiens
  chr4:147559190-147560568
  Hyper
gggagggggaggagtcgcatgcgcacagacgacccgagcctgctccgcggctgtccaatccgctgagagctgcgagaaatcgagtgagagaaagccctgcagcccctccgaccccatgtctctttggcaccaggcacccgccgggccgtggggggctcgtagccgaacgccgacctccgctcgtattgggctgggagttcagagccgcgcgcagaacccgggttggccgcaacgtctgtgttctcagcggtggccgggaacctgggatcagggtcacctgagctgacggggtgggggcgggccgagtggggttggaagcctggaacttagtggtaagcaggaggcgtaggaggtggcagccaggtaagaggcactcttacctacccaacgctggcttgggccgcaactttatttgggagtttctttttccggtgagacagagacccggcagaagaagcgggaggggctggaggctggtccttaggtaggcactgcccggcgactggagcgcggacctggccatttgggtggggttgagtgggggcgcgattgtgagtagcagccgcgggacgctgcgaaggggcggcggcaacagagcacgggcgggggcagaaaagaggcggcggagggcgcggtgggggagcgcgaggcgagtgctgagagagcagaaaggactcaagcctgaggggagtagagaggaagaaggggcaacgcgagaaaccgaacaggagccggcgtttcctggcaagggagggcggaggcgcgcgggagagagggagagagggagggcggggggcgcgggggtaggcgcggggagaggggagtataactcgccggccgcgaggagcgggggcagtttcgggtgccgaggtctgcagctagcggcaagcggagtcaggcatccgttcagactgacagcagaggcggcgaaggagcgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccctcggccagctcccccagcagctcgagcaacgctggtggtggcggcggcggcggcggcggcggcggcggcggcggaggccgaagcagcagctccagcagcagtggcagcagcggcggcgggggctcggaggctatgcggagagcctgtctt

SEQ ID NO: 123823 - DNA, 1234 bp, Homo sapiens
  chr4:147560887-147562121
  Hyper
ttattattattttaacgatctgggaatgttgtaggcgcggcgacggtgtcgagccctgggccggggcttccggagagagggcgtacaattccctgctgagcgtaatgtgtgccttctacttacaattgcagagcaatatattcggcgggctggatgagagtctgctggcccgcgccgaggctctggcagccgtggacatcgtctcccagagcaagagccaccaccaccatccaccccaccacagccccttcaaaccggacgccacctaccacactatgaataccatcccgtgcacgtcggccgcctcttcttcatcggtgcccatctcgcacccttccgcgttggcgggcacgcaccaccaccaccaccatcaccaccaccaccaccaccaaccgcaccaggcgctggagggcgagctgctggagcacctgagtcccgggctggccctgggcgctatggcgggccccgacggcgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgccggcatttagaagactcttggcctctccagagacgcccctttcctcgtccgctcttttctctcctctcttctgcctcttttcacttttggcgactagaaacaattccagtaaatgtgaatctcgacaaatcgaggactgaagagggagcgaacgagcgaacaactgagccc

SEQ ID NO: 123824 - DNA, 957 bp, Homo sapiens
  chr4:147568636-147569593
  Hyper
ttttcaggaacaaatcgatgagatagggatgcgagagagggaagatgaaggcttttcccaatctaggtcacttctttgcggagaggccttctcagagctttgggtaagtgaagaggcgccttaagttcgcggtcccagctgctcaggctccgcagcctggaggcgggaaagggaacagtgagactgagaagcaggacgcggggacagcgatctcccagaagctttcctcgcttttggtggctaatgctacgcgcctgcctgcggagctcaggcggcaccgaggaatcaagatcctcgtccccaccctccgactcaccacctaatgctttgcacaagctggccttgggttccctgctagtcccatctcccctctccacccctctggttcctggtgcgcactggtgacaggcggtttgggagagggtgaggggtagagtccaaagggctggggctgcgtggggtcagagcagaacctccctccctcgctggaggagctcgcccggtccccgaggggcccccagagctggggaagcaggcgtctcgccaggcgctcagcaaggaacccgcaagaaagagaggcccgggcgcctcgcccccttgcattttactaatcacgtctatttaaattctagcgcggtccgccgcgctctcaccgggaaagctctggagaactggacccatcaattattctgaaaaaatccctgactacgtgaggcttccagccagcgggagggaggcggcgggaggaggtggagaacccagcccctacccctctcccctcctccccgcccctcccagcgcggcctcttgatatacactcatcttcagggttctggggccccagggagacttgtgcgcattttcagggttcgagcttttgtggacgaggaaggaaggtggtgggagaaagttgggacctggcctgtgcagggcatccgcttccggagctgctatccc

SEQ ID NO: 123825 - DNA, 286 bp, Homo sapiens; identical to SEQ ID NO: 91699
  chr4:147569793-147570079
  Hyper

SEQ ID NO: 123826 - DNA, 812 bp, Homo sapiens
  chr4:147576032-147576844
  Hyper
acaggaatgagacagcggtgacagatgagcggctgggtcaggaaggagcccagttggtggaaatgacactctttccccgctccgggtcccctcccccaccccattcgcgttttctctctcggcctctcctccctcctcgccttgccctcaggcagccgaccggggacacacgggtcaaaattgcgtttgggcggcgcggcgatgcgcggtctcgggcagccgcgcaggggcgtcccgagccccgggagccgcaggctcgtccaaggatccgccgcgcggcgggcgcctgggccctccgggggcccctctggggccgcctggactcgcaggtctcccgcgccaccccctaccccattccccgcctgcgccccctgctgcgctcggcgcgcgtcctgctgcagcctgctggggacagcgcacgcagtgaccgggcgcggcagccgcttccctttcccatcgacctcgctgccttctggcttttctcaaagccttttctccagagccagacagcagacgccccggcgatgccttcgccgcccatttggccgaggtagcccaggcctgcccttgctgcctccgccggccgctccgccgcggcccaaagccggggaagcgtcccaagcccgcgcggtctgccccggagccccggaggacccgaatactcagcggaatgtcaccctggccgggttctttggattcccctccggggccatcctacggaatccagccgtccccacaagctacctcatgtaactggagacctaagaaaagactctccataccttttgacaaaaagacgtaccagaagcaat

SEQ ID NO: 123827 - DNA, 67 bp, Homo sapiens; identical to SEQ ID NO: 91702
  chr4:148079423-148079490
  Hyper

SEQ ID NO: 123828 - DNA, 528 bp, Homo sapiens; identical to SEQ ID NO: 91703
  chr4:148402212-148402740
  Hyper

SEQ ID NO: 123829 - DNA, 37 bp, Homo sapiens; identical to SEQ ID NO: 91704
  chr4:148628963-148629000
  Hypo

SEQ ID NO: 123830 - DNA, 30 bp, Homo sapiens; identical to SEQ ID NO: 91705
  chr4:148652683-148652713
  Hyper

SEQ ID NO: 123831 - DNA, 546 bp, Homo sapiens; identical to SEQ ID NO: 91706
  chr4:149364884-149365430
  Hyper

SEQ ID NO: 123832 - DNA, 43 bp, Homo sapiens; identical to SEQ ID NO: 91707
  chr4:149365868-149365911
  Hyper

SEQ ID NO: 123833 - DNA, 140 bp, Homo sapiens; identical to SEQ ID NO: 91709
  chr4:150756466-150756606
  Hypo

SEQ ID NO: 123834 - DNA, 235 bp, Homo sapiens; identical to SEQ ID NO: 91710
  chr4:150999354-150999589
  Hyper

SEQ ID NO: 123835 - DNA, 430 bp, Homo sapiens; identical to SEQ ID NO: 91711
  chr4:151000151-151000581
  Hyper

SEQ ID NO: 123836 - DNA, 30 bp, Homo sapiens; identical to SEQ ID NO: 91712
  chr4:151177716-151177746
  Hypo

SEQ ID NO: 123837 - DNA, 30 bp, Homo sapiens; identical to SEQ ID NO: 91715
  chr4:152246132-152246162
  Hyper

SEQ ID NO: 123838 - DNA, 50 bp, Homo sapiens; identical to SEQ ID NO: 91716
  chr4:152246492-152246542
  Hyper

SEQ ID NO: 123839 - DNA, 117 bp, Homo sapiens; identical to SEQ ID NO: 91717
  chr4:152928973-152929090
  Hypo

SEQ ID NO: 123840 - DNA, 55 bp, Homo sapiens; identical to SEQ ID NO: 91718
  chr4:152932523-152932578
  Hypo

SEQ ID NO: 123841 - DNA, 20 bp, Homo sapiens
  chr4:153437373-153437393
  Hypo
caactggtactggtccgtgg

SEQ ID NO: 123842 - DNA, 100 bp, Homo sapiens; identical to SEQ ID NO: 40351
  chr4:153535608-153535708
  Hypo

SEQ ID NO: 123843 - DNA, 30 bp, Homo sapiens; identical to SEQ ID NO: 91721
  chr4:153601131-153601161
  Hyper

SEQ ID NO: 123844 - DNA, 146 bp, Homo sapiens; identical to SEQ ID NO: 91722
  chr4:153702689-153702835
  Hypo

SEQ ID NO: 123845 - DNA, 99 bp, Homo sapiens; identical to SEQ ID NO: 91723
  chr4:153774393-153774492
  Hypo

SEQ ID NO: 123846 - DNA, 96 bp, Homo sapiens; identical to SEQ ID NO: 91724
  chr4:153821363-153821459
  Hypo

SEQ ID NO: 123847 - DNA, 197 bp, Homo sapiens; identical to SEQ ID NO: 91726
  chr4:153918948-153919145
  Hypo

SEQ ID NO: 123848 - DNA, 30 bp, Homo sapiens; identical to SEQ ID NO: 91727
  chr4:153943304-153943334
  Hypo

SEQ ID NO: 123849 - DNA, 369 bp, Homo sapiens; identical to SEQ ID NO: 91729
  chr4:154143815-154144184
  Hyper

SEQ ID NO: 123850 - DNA, 79 bp, Homo sapiens; identical to SEQ ID NO: 29210
  chr4:154144397-154144476
  Hyper

SEQ ID NO: 123851 - DNA, 525 bp, Homo sapiens; identical to SEQ ID NO: 91731
  chr4:154216373-154216898
  Hypo

SEQ ID NO: 123852 - DNA, 30 bp, Homo sapiens; identical to SEQ ID NO: 40356
  chr4:154372568-154372598
  Hypo

SEQ ID NO: 123853 - DNA, 115 bp, Homo sapiens; identical to SEQ ID NO: 40357
  chr4:154540115-154540230
  Hypo

SEQ ID NO: 123854 - DNA, 43 bp, Homo sapiens; identical to SEQ ID NO: 91734
  chr4:154605841-154605884
  Hyper

SEQ ID NO: 123855 - DNA, 606 bp, Homo sapiens
  chr4:154680759-154681365
  Hyper
gagggactggcaccccgcacggtggcatcttccagaaggtcatgcgtccgtccccacgtctttccagggccggttctccccggtggggcccggggtcttggagaccagtctgtgcagcctgcccggcaccagcgtgagccccgggaccccggcctggcgtcccccacgcccgcgcccccgcgccagtacctgctcctgctgcgggggggcctccagcaccggcgctgccttccgcgccgccgtccccgcggccatgcctgagccactgtgccttctccagggcacagcgcctgccggggagggtcccgcagagtccgcagaaggaggcgccgcggggcctcgggagccgagggtgagagccggatctgcggcggcggcggagcggcggccctgcccgggttgtgcggggcgggagatgggagcctcccggcacgccccgcctccgccccctgcacgctggccagcgtcctccccagcagcggcctcgaggtcccggtcgccagcaccccggttccttcagaacctcaggcctcccattcagccagccattgtcgccgataaagcgtcttgagccctaccgggtgcgtgtggcgggaaccccggttt

SEQ ID NO: 123856 - DNA, 232 bp, Homo sapiens; identical to SEQ ID NO: 91737
  chr4:154702510-154702742
  Hypo

SEQ ID NO: 123857 - DNA, 1534 bp, Homo sapiens
  chr4:154709106-154710640
  Hyper
aaacaccacttccaacgctctgcgcagctccagtgctagcatctttaacaataatcgtgtatctatttttttttaaaccgccgttcagttcttcgtttttttagttttgttgtttttgtttgtttgttttatttttaaactgcccttaagtatagctggtacaactcgggaggagaatgcgcgagacttgggcggcgtgggaggggtgcctcaaatttgatacaggcttgttgtgatgacagaccaggtcaggcagaacttctgcccttcccgctactggcaccccaagcagggatgcactgggatgcgtggcaggggcgggatctcctgggagcgtctcagcccagcagggagtggggaagcaagagggaaggcttaccttcctcggtggctggcaggaggtggtcgctgctagcgagggggatgcaaaggtcgttgtcctgggggaaacggtcgcactcaagcatgtcgggccaggggaagccgaaggcggacatgaccggggcgcagcggtccttcacctgcacgcagagcgagtggcatggctggatggtctcgtctaggtcatcgaggcagacgggggcgaagagcgagcacaggaacttcttggtgtccgggtggcactgcttcatgaccagcgggatccaagcgccggcctgctccagcacctccttcatggtctcgtggcccagcaggttgggcagccgcatgttctggtattcgatgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcgggctgcgggagtggggggcacgcagggcaccccgcgagcggcctcgcgaccaggtactggcgggaacgcgcctagccccgcgtgccgccggggcccgggcttgttttgccccagtccgaagtttctgctgggttgcca

SEQ ID NO: 123858 - DNA, 214 bp, Homo sapiens
  chr4:154710700-154710914
  Hyper
tgttggggggctgcgtccctggtagccgcgtgtgccctgtgatggagcccgggacctgcccgcccgaggccgcctcggcgaacttcgttttccctcgaatctccagccaccgttcagcagcctgtcggtgtgctccccaatgccgtaaaaaaatcagaattataaatatattcgtatgagcagaactttacatggaaaacgaaatactaataaa

SEQ ID NO: 123859 - DNA, 708 bp, Homo sapiens; identical to SEQ ID NO: 29220
  chr4:154712003-154712711
  Hyper

SEQ ID NO: 123860 - DNA, 510 bp, Homo sapiens
  chr4:154713500-154714010
  Hyper
aggtgaagtgactaccgggctagccttggggacctgtcgcgacttgtcgggtgtctccaaccgcgttgccgcctggctttcagccgtgcgctggccagccgggcgggtgacgtcacctctccccgggtccgtgcacccaggccttccctgctccgggtgagtattttttcatgggattcagccatctgggggcgccatttcccaaaacagagattgtccctttgaggttgcaagtcaggttcctttacgctgagatcccttacatttttacttttaggaaggttttttcgaggggtggggggatgacctcattccttcgcctttggccctccctctacccggccccacaacgaggacgcccctgcagctggctgggccgcttcctcttgccacgcggggggacctgtgcccgcggccgtgcacctccgtgtacgcttctgctcctcggaccccatcggttcagacgcggatttccgagaacgagaccagagtctgcgtctggagagcctt

SEQ ID NO: 123861 - DNA, 52 bp, Homo sapiens; identical to SEQ ID NO: 91746
  chr4:154727418-154727470
  Hypo

SEQ ID NO: 123862 - DNA, 569 bp, Homo sapiens; identical to SEQ ID NO: 91747
  chr4:155254047-155254616
  Hyper

SEQ ID NO: 123863 - DNA, 40 bp, Homo sapiens; identical to SEQ ID NO: 40359
  chr4:155321157-155321197
  Hypo

SEQ ID NO: 123864 - DNA, 73 bp, Homo sapiens; identical to SEQ ID NO: 91749
  chr4:155337912-155337985
  Hyper

SEQ ID NO: 123865 - DNA, 390 bp, Homo sapiens
  chr4:155411321-155411711
  Hyper
tggcaacctcaggctcggcgcctccatcgcgggcctccaccaccaactggtgccaggcctgtgcctcgcggtccagaggtctccacactcgcaccacgccgctcagctcctccaccgcgaagtaggccgcgtcgcccagtgccccgccgccgctacccgccccaggcacttgccgggcgcggacgctgtagcgcacgaagccattgggccccaggtcgcggtcggtggcgcgcacgcgacagacctcggcgcccggctgggcgtcctcgcgcaccgcggcgcggtactcgtcctgctcaaagaccggcgggttgtcgttctcatccagcacgcgcagctccacgctcaggaggccggtgcgccggggtcggccgccgtcccatgcctcga

SEQ ID NO: 123866 - DNA, 429 bp, Homo sapiens; identical to SEQ ID NO: 29225
  chr4:155412014-155412443
  Hyper

SEQ ID NO: 123867 - DNA, 30 bp, Homo sapiens; identical to SEQ ID NO: 91752
  chr4:155412753-155412783
  Hyper

SEQ ID NO: 123868 - DNA, 33 bp, Homo sapiens; identical to SEQ ID NO: 91753
  chr4:155413097-155413130
  Hyper

SEQ ID NO: 123869 - DNA, 185 bp, Homo sapiens; identical to SEQ ID NO: 29226
  chr4:155413374-155413559
  Hyper

SEQ ID NO: 123870 - DNA, 88 bp, Homo sapiens; identical to SEQ ID NO: 91755
  chr4:155444677-155444765
  Hypo

SEQ ID NO: 123871 - DNA, 72 bp, Homo sapiens; identical to SEQ ID NO: 91756
  chr4:155445409-155445481
  Hypo

SEQ ID NO: 123872 - DNA, 289 bp, Homo sapiens; identical to SEQ ID NO: 91757
  chr4:155548046-155548335
  Hyper

SEQ ID NO: 123873 - DNA, 1295 bp, Homo sapiens
  chr4:155663050-155664345
  Hyper
ataagcattataagccgccttagtgaccaccagggacggaaaccgttaattatcacgtttcctttcatctccaggggccctttggcccgtgacacaagaggcttcggtattggcgctttcccagaactggcccagaggagccagttcagagtgtgaggtcgggtctgcattgaacgtacacaccgaggtctatcagactcccccgattttagcgaagggtgctgactgctgtgctgctagaggctagcaagctccctgtgcgcagctgatgagtttcagcaactcgccacctgggcgcttttctttaaattttgggagtaaactgggaaaataaaaaaatctccacgtccactggctctctccccttctccaacttcctctttcgactcgtttgtgggagttttctcctctttgctgggactataatgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatggcccccttcgtcttccaggtaaaatgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagtcgggctgcaggcgcacgggcaaagaacttagcatctcatccaagtacttcgccttccttggccgtctccgggaggttatgcttaaaaacataaaaataaaaataaaaataaaaataaagggaggcggacaaagtttcggtgggtgaactgaagctgggtccatgtgaccctgaagccggagaaataaacttaacatgaatcttgctttcctggcgggcgttgggaccccgccgtttttcatgccaaccgttggaagcttcgtactcaacggccacaggtgcctaggagcgcagagaggcctcgggttcaaatcaccggcgcgcagggactggactcgcgggtagcgacccccccaacccccccccccccgccctacacacacaccctcgcgccggctgaaagcatggaggattcagggcatttg

SEQ ID NO: 123874 - DNA, 398 bp, Homo sapiens
  chr4:155665077-155665475
  Hyper
tttccgggtctgtgacggccttcggctccgccccctcgacggccataaaaagtcgcagcgaagcctgcacctccgagcaccgcgcgcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggtgagcagcagcgcagcacccctgcccggcgagcttaacttgcccagcccggcccctgccggagtggcaccggcacctctccaagacgccctcttccctgc

SEQ ID NO: 123875 - DNA, 57 bp, Homo sapiens; identical to SEQ ID NO: 29231
  chr4:155665721-155665778
  Hyper

SEQ ID NO: 123876 - DNA, 179 bp, Homo sapiens; identical to SEQ ID NO: 91765
  chr4:155677682-155677861
  Hypo

SEQ ID NO: 123877 - DNA, 1144 bp, Homo sapiens
  chr4:156129153-156130297
  Hyper
agcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagtaagtgtaattcctaactctgatcacctcctgggaacaagaaaatccctagaggagcgctcggttcctatgaaga

SEQ ID NO: 123878 - DNA, 646 bp, Homo sapiens
  chr4:156297387-156298033
  Hyper
cttcaaaataagtcacgtcttatttaaaaggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaagccaatttttcctctcacaaaagtgttaaagagagccagacaaaacgacgaagctttcgcgatgagccgcattaaaatcgcggtttcccgtactcggagcagaggcctggcagggccgcccatagcgttgtgcgccccgggttccgttccctaccaggccaggtgacgtccgggtgctcgccgctcctcaccgcgccgtatgctgagcaccagcgaacgccaggcccgtgcacgtccaagcgcggtctctgtccggatcccccatggcccccaggtcccgctttctgttcccggccccggacgcccgcggccagttctccgcgaccctgagaatcaagagccaagcatcgggtaggagctgctcaccttggtctgggcctggcggcgcccgcagagccggtcctggaccgagcgaggaggaggggctaataacagaggcggagggcggttgctaggaaacagcgtcttcgggaggaa

SEQ ID NO: 123879 - DNA, 84 bp, Homo sapiens; identical to SEQ ID NO: 91773
  chr4:156588083-156588167
  Hyper

SEQ ID NO: 123880 - DNA, 653 bp, Homo sapiens
  chr4:156588456-156589109
  Hyper
gcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtacgctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtgggtaagaggcgcgtcctcctccacag

SEQ ID NO: 123881 - DNA, 30 bp, Homo sapiens; identical to SEQ ID NO: 91777
  chr4:156589333-156589363
  Hyper

SEQ ID NO: 123882 - DNA, 85 bp, Homo sapiens; identical to SEQ ID NO: 91778
  chr4:156676892-156676977
  Hypo

SEQ ID NO: 123883 - DNA, 217 bp, Homo sapiens; identical to SEQ ID NO: 91779
  chr4:156680166-156680383
  Hyper

SEQ ID NO: 123884 - DNA, 271 bp, Homo sapiens
  chr4:156680699-156680970
  Hyper
agggtgggaagatagcgtgggggtggggcggatggtgacggggagaatccaccagggattggggggttgcgcccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgct

SEQ ID NO: 123885 - DNA, 198 bp, Homo sapiens; identical to SEQ ID NO: 91782
  chr4:156681186-156681384
  Hyper

SEQ ID NO: 123886 - DNA, 17 bp, Homo sapiens
  chr4:157119858-157119875
  Hypo
gtcgtgaggaacaccta

SEQ ID NO: 123887 - DNA, 41 bp, Homo sapiens; identical to SEQ ID NO: 29244
  chr4:157892721-157892762
  Hyper

SEQ ID NO: 123888 - DNA, 278 bp, Homo sapiens
  chr4:157997385-157997663
  Hyper
actgccacctgggcccggagcctccacgatctcgcccggcgattgtgggcaggggcgcctccgggtaagtgccaggagctccacttaggaggaggggacgcgggttggggcggcgacggtggtctgaggacgggaatagacgcctttgcggaaacagcgggtcaagcccggggcggcggagcgcgaggagcactgcggcgtgcccgggaggacgcgcgctgccctgcgcgggagaggggcgcggggcgcctggcagcggcagccgggtccccgctgcg

SEQ ID NO: 123889 - DNA, 120 bp, Homo sapiens; identical to SEQ ID NO: 91793
  chr4:157997864-157997984
  Hyper

SEQ ID NO: 123890 - DNA, 30 bp, Homo sapiens; identical to SEQ ID NO: 91794
  chr4:158006556-158006586
  Hypo

SEQ ID NO: 123891 - DNA, 217 bp, Homo sapiens
  chr4:158141554-158141771
  Hyper
gctgaaaggccgaggcgcgcggtgggcgcgacagccccggagacccgaggtctcgcggagggacagcggctacgggccccgagctgtgctttctcagcgccgcgcacgcgacgcgtccacggtggtgcggggtgccgggcgccgtgcgggggagggggcgcgcgctcccgcctcctgccgcgagtcgcgcacgcgcgcccgggactgcctgcccctc

SEQ ID NO: 123892 - DNA, 156 bp, Homo sapiens; identical to SEQ ID NO: 91797
  chr4:158141831-158141987
  Hyper

SEQ ID NO: 123893 - DNA, 265 bp, Homo sapiens; identical to SEQ ID NO: 91798
  chr4:158142758-158143023
  Hyper

SEQ ID NO: 123894 - DNA, 413 bp, Homo sapiens
  chr4:158143291-158143704
  Hyper
cacctcgctccccatcgagcgcctgttggcaccctgcccacagagaacacgttgttccccagggcgcgcagtcgggctgttggacaaatcccacgagggactgccggagcccagtggcctcctgccccagcagctgccgctctcgcccgctgcccccagtttagatccgcagcaccggctgggctcaccctgcggccctcgcgagctccatgttctcctctttgggacaagttgttgaaatggttccggagttgggatcggggctgttacataacgcccacccgaggggcgaggagcggggctgacgcaggctcaggccggccgggtggcgtgggggtggggcggggaggcggtggaaagggggagcgctgtcaatttctcctgctcagttgcgcttccgcttaagttggagg

SEQ ID NO: 123895 - DNA, 252 bp, Homo sapiens; identical to SEQ ID NO: 91801
  chr4:158144020-158144272
  Hyper

SEQ ID NO: 123896 - DNA, 428 bp, Homo sapiens; identical to SEQ ID NO: 91803
  chr4:158740662-158741090
  Hypo

SEQ ID NO: 123897 - DNA, 43 bp, Homo sapiens; identical to SEQ ID NO: 91805
  chr4:159927254-159927297
  Hypo

SEQ ID NO: 123898 - DNA, 30 bp, Homo sapiens; identical to SEQ ID NO: 91817
  chr4:162044644-162044674
  Hypo

SEQ ID NO: 123899 - DNA, 237 bp, Homo sapiens; identical to SEQ ID NO: 91819
  chr4:163085242-163085479
  Hyper

SEQ ID NO: 123900 - DNA, 898 bp, Homo sapiens
  chr4:164252883-164253781
  Hyper
ctcctaacccagccacgttccatcattacttttctaaaagaaagagctaaagagttccctgattagaactccgatgattaaaagcttcgggtgtctatcggggcgcagcgccacactcgaagcgcccggtactgcggagcgcggctcgattgcagccgagaagcgcggaacccgcaagtgggggtgggcttgcgcgctggggtccgcgccgagggctactcccacctccgccagctcccagcccgacacctgccgcgggacccgtgcgacgctgggcgacgcgccaagcccacccttctccggctcatcccagccagttactccgcgaaaactccggtgcggccagagccagcgcctccagccagctcaagacacgtaaggaaaatgagcgggtgtgggataggcgaactcgggcgccttcccagtgcctcggccttttaaagagaaccggggtaaaggaaaacttggatccccatccagaaattccccgggagcaggtggtgggaaagcccgaactccgcgtagggtaccctctcctttcacccgcgtcgtccccatacccttcggcaggagcccgcgaacggtccggtgatttggagcaacctgcgacctgcctgcactggagaccccaccttggtcccccagagccagtttcggacactcgcatcgtttttcttcccctctcatccttcaccttgtcaatgagagatttcgcagaagtctctggaaaggcataaactcgcaacttaccctctttggaatttgtctttttcgctcctgcttattaaagaaggaagggtgggaatggaagggagcagagtggggaagatccgctggtatttctcctgctcagatcctaaagattgatgaagctaggaagagacgcctccttaaagcc

SEQ ID NO: 123901 - DNA, 1179 bp, Homo sapiens
  chr4:164264670-164265849
  Hyper
ataaaacctgagagtcgaagcttgttctcaggaatactaagaacttaggggcacagccatcctcacaccagtccaagacttctcagagttcactacacagggttgagggctggaccggcaaaactcgatttgcccatcaagttaacttggtcggcctgggacccgaggccagggtgaagggacgacatcccggggccctgtggcttctccctagagcgcccaaacagcggcgtaggtctgggacgcccccggcccccggctttggaagaggctggcgcggagcaggcgccttggagcagggtctcgggggtccccggaacagtcacgtgttctcgagacgccgttaaacccccgccccctcttccccaccgccgcctccaggtcctgctcccgctgctgccgccaccgccggggtgcaggagcgatcgcgctgggccgcgctcccgggagcccagggcctgcagcggccggggcgccccgaggtacgggctcccgcccctccctgccaacccctttcgcgccgggtaggcctgcaccgaggggccgtggcgggtccccgcgcgggctgcgagtctgcgcaggtccctgggagcccgcacccgtctctggtgccagggcgttgtcgggggtcccaagagagcggggtggggaaggtgaagggagcgcggctggaaaaatggggattagggtggcggaacaggcacttgtcaggagtgaagagacagcggagagggtactgggctgaattctttcgtgccgagcaggtccctccggttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaactcgaattccagaaacgggaattctttttt

SEQ ID NO: 123902 - DNA, 777 bp, Homo sapiens
  chr4:165304413-165305190
  Hyper
tctcgcccaggagggcggttgcagggaaccgaaatcggacacaacagttgcagtgaacccgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccggcggagggtgaagtagctcaggcggccgccaggctgcgtgcggccggcatcccggggcgcgggcattctcccatcctttgtcagttgcgggtggagcgctcctccccagctagcggacgagcagccgggtggcaggcagcccggctctggctcggctccccagtcct

SEQ ID NO: 123903 - DNA, 36 bp, Homo sapiens; identical to SEQ ID NO: 91828
  chr4:165854310-165854346
  Hypo

SEQ ID NO: 123904 - DNA, 526 bp, Homo sapiens; identical to SEQ ID NO: 91829
  chr4:166299918-166300444
  Hyper

SEQ ID NO: 123905 - DNA, 42 bp, Homo sapiens
  chr4:166414393-166414435
  Hyper
ggaaggaatagaccacgatgttacatccggtgggtctttgcc

SEQ ID NO: 123906 - DNA, 30 bp, Homo sapiens
  chr4:166414891-166414921
  Hyper
tccgtataataaatccgcagggattcaagg

SEQ ID NO: 123907 - DNA, 30 bp, Homo sapiens; identical to SEQ ID NO: 91833
  chr4:166463182-166463212
  Hypo

SEQ ID NO: 123908 - DNA, 265 bp, Homo sapiens; identical to SEQ ID NO: 91834
  chr4:166793773-166794038
  Hyper

SEQ ID NO: 123909 - DNA, 1064 bp, Homo sapiens
  chr4:166794574-166795638
  Hyper
ggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccggtaagtggctctccaggttgggacggtggcgcgccgggggccgctgcgctgggtttcccatgggtggcggtgggagctcacctgtttccttccctcccgcgtcagcccctccgccgcccctccttctctccccctccttttccttcccttccccacccgcaagtggcagccgctgcggccccagttgactagagttctgtgccagtgggatccactgccaagctcccatctcccagtttgggaataaggtcctagagtttctgatccctctcccctcccccagcaaaacgaaacaagtcgtaaatatagcttgctgctgtaggttttaaattccaacactcagcgggctttatgcatatggaagggacaccgtcttctttcccctctcccccagggcgcggtttcccagcgct

SEQ ID NO: 123910 - DNA, 307 bp, Homo sapiens
  chr4:166795969-166796276
  Hyper
ttcccctcccttctacgcctctggcgccgctgccagcctctcgcgcgcgcggggcggcgcttccctctcgccgcctaaggtcggaggcgcacgtgcccggggccgctaccacgtgagcgcagcgcctgagggcgcccagcactggccgcggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcggaaggcacgttag

SEQ ID NO: 123911 - DNA, 23 bp, Homo sapiens
  chr4:167721038-167721061
  Hypo
aagtatgaaaatggccgggcacg

SEQ ID NO: 123912 - DNA, 547 bp, Homo sapiens
  chr4:168154961-168155508
  Hyper
gctgggagggggcagcggaactgtgaacttctccagcagccctgcgccgccgcgtttccctaaacccctctcctcagaaaacggagcccactccccacccacatccggcggccgcggcccccgcctcggagcagcgcgcgcgtgtgcccggggatgtgggtgcgcggaacttacgtctcggaatttgttccactgtccgacttccttgtcatactgagagattgtggtgagccattgtttatcatccagaaaattaccgccgtccgaccgccccccggctgcagccaccgccgcggcagctgcgagagactgactgcaccaagcggctgcacacacacacagtacggctgacaccttgagcatctgggagaggagacacaacggggggtgggggggcatgtcagtgtcaaataaggggtacgaagccaggagcgaccctggaaaacatgcattagcaacgacgagggtagagggaggaggagacaagcagaggcaagcgtgtcccctccccgcaggctttacccccaaaagccgggcactcacacac

SEQ ID NO: 123913 - DNA, 79 bp, Homo sapiens; identical to SEQ ID NO: 91843
  chr4:168155788-168155867
  Hyper

SEQ ID NO: 123914 - DNA, 72 bp, Homo sapiens; identical to SEQ ID NO: 91847
  chr4:169553199-169553271
  Hyper

SEQ ID NO: 123915 - DNA, 169 bp, Homo sapiens; identical to SEQ ID NO: 91848
  chr4:169753974-169754143
  Hyper

SEQ ID NO: 123916 - DNA, 153 bp, Homo sapiens; identical to SEQ ID NO: 40364
  chr4:170484641-170484794
  Hypo

SEQ ID NO: 123917 - DNA, 35 bp, Homo sapiens; identical to SEQ ID NO: 91850
  chr4:170537901-170537936
  Hypo

SEQ ID NO: 123918 - DNA, 26 bp, Homo sapiens
  chr4:170865261-170865287
  Hypo
ggtttcgtctgcggcttgtcctgcta

SEQ ID NO: 123919 - DNA, 30 bp, Homo sapiens; identical to SEQ ID NO: 91852
  chr4:170899334-170899364
  Hypo

SEQ ID NO: 123920 - DNA, 30 bp, Homo sapiens; identical to SEQ ID NO: 91853
  chr4:170912774-170912804
  Hypo

SEQ ID NO: 123921 - DNA, 93 bp, Homo sapiens; identical to SEQ ID NO: 91854
  chr4:170916682-170916775
  Hypo

SEQ ID NO: 123922 - DNA, 30 bp, Homo sapiens; identical to SEQ ID NO: 40365
  chr4:170919945-170919975
  Hypo

SEQ ID NO: 123923 - DNA, 592 bp, Homo sapiens; identical to SEQ ID NO: 91856
  chr4:170947275-170947867
  Hyper

SEQ ID NO: 123924 - DNA, 318 bp, Homo sapiens; identical to SEQ ID NO: 91857
  chr4:170948515-170948833
  Hyper

SEQ ID NO: 123925 - DNA, 62 bp, Homo sapiens; identical to SEQ ID NO: 91858
  chr4:171544709-171544771
  Hypo

SEQ ID NO: 123926 - DNA, 15 bp, Homo sapiens
  chr4:171964525-171964540
  Hypo
cgggcctcagctgcc

SEQ ID NO: 123927 - DNA, 24 bp, Homo sapiens
  chr4:172498649-172498673
  Hypo
tttttttttttgagacggagtctc

SEQ ID NO: 123928 - DNA, 80 bp, Homo sapiens; identical to SEQ ID NO: 91862
  chr4:172596057-172596137
  Hypo

SEQ ID NO: 123929 - DNA, 32 bp, Homo sapiens; identical to SEQ ID NO: 91863
  chr4:172596627-172596659
  Hypo

SEQ ID NO: 123930 - DNA, 1637 bp, Homo sapiens
  chr4:172733596-172735233
  Hyper
aagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggctcgggggatcccctctccctgggaccggccctgtcccgggtcgcctccacctcccgcagccgccgcgccccggctcgccgcgctcccgccggcaccatggaggaattcctgggacaaccgcctgcagccggcgacttttccccaggaatctctggcctggcgccctttgggtgagatgacggggtgctggcatccctgtcggtcccagattacccggaaaagccctggcaggtaaagagaggacccgcgcaggctgggagctcccactcctcctccagcgtcacgctcgccctccgccgctgcctcgcgtccgggtctgtttatatagcgtctggaggccgggaggcattgcccacccccgccaggcggcccgccctcccctcctgggctccgggctgccgcacgtggcagacaccagcgacgtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttc

SEQ ID NO: 123931 - DNA, 24 bp, Homo sapiens
  chr4:172903767-172903791
  Hypo
tcttccagacgagcttgttggagg

SEQ ID NO: 123932 - DNA, 17 bp, Homo sapiens
  chr4:174307595-174307612
  Hypo
gccgtgtttatatacac

SEQ ID NO: 123933 - DNA, 55 bp, Homo sapiens; identical to SEQ ID NO: 91872
  chr4:174429633-174429688
  Hyper

SEQ ID NO: 123934 - DNA, 917 bp, Homo sapiens
  chr4:174430233-174431150
  Hyper
tattattccacttcacgagtactaaggaggagtccagaattggtggccgtcctccctcttgttttctcatgcaaataactcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccccgggagcacgacggatagaatgcgcggggtcgagacggtgtcggtagcgggggccgcagcgctttgcaaagccggcctctgcccccggcctccttggagggcggtagcgggacctgcgctcgcagcctctccccagggctgtgcgcttcggcctggcggctgccgggcaaaaacctcatttatttccttccttcccgagtgagctcacttcctccccgcgccgctcccttccgtcggccggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttctctttctggccctcatttcccctgcttctcactttagttcactgctgttttaaaaattcatatgcgggctcatttaaaa

SEQ ID NO: 123935 - DNA, 620 bp, Homo sapiens
  chr4:174437927-174438547
  Hyper
tacgcagaggcgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaaccttttacaaggcatgtgggtacaagaaaaaaaatcaaaataaaccactttcatccagcatgggcagtgaaaagaaaagctgccttccagagggggcgagcgggagttttgaaat

SEQ ID NO: 123936 - DNA, 551 bp, Homo sapiens; identical to SEQ ID NO: 91876
  chr4:174439797-174440348
  Hyper

SEQ ID NO: 123937 - DNA, 125 bp, Homo sapiens; identical to SEQ ID NO: 91877
  chr4:174440635-174440760
  Hyper

SEQ ID NO: 123938 - DNA, 30 bp, Homo sapiens; identical to SEQ ID NO: 29281
  chr4:174443212-174443242
  Hyper

SEQ ID NO: 123939 - DNA, 634 bp, Homo sapiens
  chr4:174443551-174444185
  Hyper
agatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtccggcccccggaaacgtgggattggtttcctctcccggagttctcccctcccccttctttctaaacatttaaaaaacacgtagtccgtctcccccaacccccattcccggtagacttaatcccaacagcaattcattgcaccgcggagcttcctcagggagggggctgttggagcctccaaccagggtcctgggccccagtctgagaatgactcctgggtttttctctccaagcgatccgcaggctctgacag

SEQ ID NO: 123940 - DNA, 82 bp, Homo sapiens
  chr4:174446434-174446516
  Hyper
gcgttgtcagccgcccgcagaagtccgcagagcctctagcttgtctctccctgggcacttctgaattcgcccacgccgggtc

SEQ ID NO: 123941 - DNA, 345 bp, Homo sapiens
  chr4:174448318-174448663
  Hyper
aaggagtcctcagagcggagcgcggacggcttttccggagtcctgggtctgcatctggcgccttggcccctgctcactcgcgctctcctcctcctccttctcctcctcctcactgcttgagctccagggcccagacgtgctgcggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtccc

SEQ ID NO: 123942 - DNA, 38 bp, Homo sapiens; identical to SEQ ID NO: 29284
  chr4:174449624-174449662
  Hyper

SEQ ID NO: 123943 - DNA, 2283 bp, Homo sapiens
  chr4:174449899-174452182
  Hyper
tcttctcctctttcacgtcggtcttcttgatctctgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccaccgggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatct

SEQ ID NO: 123944 - DNA, 327 bp, Homo sapiens
  chr4:174452445-174452772
  Hyper
ttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccag

SEQ ID NO: 123945 - DNA, 529 bp, Homo sapiens
  chr4:174459122-174459651
  Hyper
atgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggt

SEQ ID NO: 123946 - DNA, 365 bp, Homo sapiens; identical to SEQ ID NO: 91890
  chr4:174459856-174460221
  Hyper

SEQ ID NO: 123947 - DNA, 466 bp, Homo sapiens; identical to SEQ ID NO: 91891
  chr4:175132735-175133201
  Hyper

SEQ ID NO: 123948 - DNA, 1293 bp, Homo sapiens; identical to SEQ ID NO: 91892
  chr4:175134868-175136161
  Hyper

SEQ ID NO: 123949 - DNA, 83 bp, Homo sapiens; identical to SEQ ID NO: 91893
  chr4:175137696-175137779
  Hyper

SEQ ID NO: 123950 - DNA, 1458 bp, Homo sapiens; identical to SEQ ID NO: 91894
  chr4:175138499-175139957
  Hyper

SEQ ID NO: 123951 - DNA, 604 bp, Homo sapiens; identical to SEQ ID NO: 91898
  chr4:175443197-175443801
  Hyper

SEQ ID NO: 123952 - DNA, 884 bp, Homo sapiens; identical to SEQ ID NO: 91899
  chr4:175749823-175750707
  Hyper

SEQ ID NO: 123953 - DNA, 22 bp, Homo sapiens
  chr4:175836862-175836884
  Hypo
ccgcgcccggccccattgttta

SEQ ID NO: 123954 - DNA, 87 bp, Homo sapiens; identical to SEQ ID NO: 91901
  chr4:175940800-175940887
  Hypo

SEQ ID NO: 123955 - DNA, 45 bp, Homo sapiens; identical to SEQ ID NO: 91903
  chr4:176394073-176394118
  Hypo

SEQ ID NO: 123956 - DNA, 1036 bp, Homo sapiens
  chr4:176922653-176923689
  Hyper
gttcttcctcccctccgccacacgcagtcacattcctggagctattccaagctgcctccgctaagcaccgaataagcggaccctgcctggaaacttgagcgaagctgaactgcgccgaactccaccgtccagtgacccgagccagtgtggacgcccttttaatcacgctgtttacccaggtggaatttaggaagaatcagccttcagcctcaacctcaaaccttttgtgcaaatgggcacttcgtttggaaagggactagaaattgtccccagtctggccctgcaccagcaccttcctctgctcaaacctgtacaaagtggaagttttaggaagtttccatttctcgtgccccgtttcaacttgctccccaaagagaacatgaaaacgtgggaactcgggaggacagagatctccctgtaatcgcctcgctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctccctctttccacctgcctcctctgcgagaagcccgttttcctcccctt

SEQ ID NO: 123957 - DNA, 537 bp, Homo sapiens
  chr4:176986819-176987356
  Hyper
ctctgcccaaagcctcgctccagtacggaggagctgcgccttcaacacactttctctgttgccaggtaaccacttctccctcagcctagtctccaagggtcacgagccacttccgcctccccctctcgggcgctccaatcagcgacctgtgtagctgtcacgtgggcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggtaagaagccggtggggccgcagagataccaaggcaagctcaggattgatgtgggtgatgctggaactgtcgcggcgtcatgcgagaggggctctgacctccctgtgatcgcggaccagggtaatg

SEQ ID NO: 123958 - DNA, 1177 bp, Homo sapiens; identical to SEQ ID NO: 91912
  chr4:177713228-177714405
  Hyper

SEQ ID NO: 123959 - DNA, 182 bp, Homo sapiens; identical to SEQ ID NO: 91917
  chr4:177973020-177973202
  Hypo

SEQ ID NO: 123960 - DNA, 20 bp, Homo sapiens
  chr4:178109673-178109693
  Hypo
tttttttttttgagacggag

SEQ ID NO: 123961 - DNA, 25 bp, Homo sapiens
  chr4:178599692-178599717
  Hypo
tgcgcccagccgagtccatttggga

SEQ ID NO: 123962 - DNA, 73 bp, Homo sapiens; identical to SEQ ID NO: 91923
  chr4:179443386-179443459
  Hypo

SEQ ID NO: 123963 - DNA, 30 bp, Homo sapiens; identical to SEQ ID NO: 40370
  chr4:180818589-180818619
  Hypo

SEQ ID NO: 123964 - DNA, 426 bp, Homo sapiens; identical to SEQ ID NO: 91931
  chr4:180979223-180979649
  Hyper

SEQ ID NO: 123965 - DNA, 406 bp, Homo sapiens; identical to SEQ ID NO: 91932
  chr4:180980004-180980410
  Hyper

SEQ ID NO: 123966 - DNA, 40 bp, Homo sapiens; identical to SEQ ID NO: 91933
  chr4:180980984-180981024
  Hyper

SEQ ID NO: 123967 - DNA, 24 bp, Homo sapiens
  chr4:181546386-181546410
  Hypo
cttttttttttgagacggagtctc

SEQ ID NO: 123968 - DNA, 155 bp, Homo sapiens; identical to SEQ ID NO: 91936
  chr4:182558152-182558307
  Hypo

SEQ ID NO: 123969 - DNA, 30 bp, Homo sapiens; identical to SEQ ID NO: 91938
  chr4:182982724-182982754
  Hypo

SEQ ID NO: 123970 - DNA, 114 bp, Homo sapiens; identical to SEQ ID NO: 91939
  chr4:183062432-183062546
  Hyper

SEQ ID NO: 123971 - DNA, 1851 bp, Homo sapiens
  chr4:183063666-183065517
  Hyper
gtttctggttctgcacggtagttaaaaatgcaagtggatttcctaacggccgagtacaggtacaggtggaggtcggcggaatcctctgctctgaagctgaaagtggagggtggcgcgaggcggctggcgcgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccgcactcactcggcagccccaagcacgcacgccccacctctgccgccgccccgtcccggacccgaaaggagcctgaaggatcccgccgaccacccagccagagagcggttcggctcaggtcgcccattcggagctacaaaactctggaacctccagcagtttcggaagctccgggggagggctttcctgcagacagggggcgggagctagggagccgggagccagcgctgcggtgggaacttcagtgagtagaaagtggccagtgtcttgggaggagcagcaaactttttttttccctcccacagcaaacaaaatcgaggcagggacagtgtccggccgctaatctgaggggagaatggagaggaaagaagagtagtaaaagtggggagtggagccttcggaggactcccgggtccgcccctggccaggtgatgcggggcggaggcctaggtgcttgaacctggggggcagacaattgttctgctgcagtgcccaccaggggctggtaaggaagtctgagtgtttactgcctcccttccctgtccaaaggtcatttgcgcttttcggtctcggacgaaagaacactgtggaaaggaaggcgcgggtcattttcagaggctctgcaaaggacgggccgcctaccgggggtggaaatccttaattacacccttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacctggcccttctcgccttcctcctccc

SEQ ID NO: 123972 - DNA, 360 bp, Homo sapiens; identical to SEQ ID NO: 91942
  chr4:183065946-183066306
  Hyper

SEQ ID NO: 123973 - DNA, 32 bp, Homo sapiens; identical to SEQ ID NO: 91943
  chr4:183115488-183115520
  Hypo

SEQ ID NO: 123974 - DNA, 24 bp, Homo sapiens
  chr4:183256665-183256689
  Hypo
aaaaaaagacgaagcatttgccat

SEQ ID NO: 123975 - DNA, 1005 bp, Homo sapiens
  chr4:183369261-183370266
  Hyper
ttcagcccctggtaccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcct

SEQ ID NO: 123976 - DNA, 158 bp, Homo sapiens; identical to SEQ ID NO: 91947
  chr4:183370559-183370717
  Hyper

SEQ ID NO: 123977 - DNA, 22 bp, Homo sapiens
  chr4:183447416-183447438
  Hypo
gccaccgcgcccagctacattt

SEQ ID NO: 123978 - DNA, 16 bp, Homo sapiens
  chr4:183690642-183690658
  Hypo
agagcagtcctaggcc

SEQ ID NO: 123979 - DNA, 30 bp, Homo sapiens; identical to SEQ ID NO: 91950
  chr4:183696298-183696328
  Hypo

SEQ ID NO: 123980 - DNA, 212 bp, Homo sapiens; identical to SEQ ID NO: 91951
  chr4:183727706-183727918
  Hyper

SEQ ID NO: 123981 - DNA, 30 bp, Homo sapiens; identical to SEQ ID NO: 40371
  chr4:183959079-183959109
  Hypo

SEQ ID NO: 123982 - DNA, 30 bp, Homo sapiens; identical to SEQ ID NO: 91953
  chr4:183994250-183994280
  Hypo

SEQ ID NO: 123983 - DNA, 691 bp, Homo sapiens; identical to SEQ ID NO: 91954
  chr4:184019209-184019900
  Hyper

SEQ ID NO: 123984 - DNA, 1152 bp, Homo sapiens; identical to SEQ ID NO: 91955
  chr4:184020126-184021278
  Hyper

SEQ ID NO: 123985 - DNA, 42 bp, Homo sapiens; identical to SEQ ID NO: 91956
  chr4:184205414-184205456
  Hypo

SEQ ID NO: 123986 - DNA, 30 bp, Homo sapiens; identical to SEQ ID NO: 91957
  chr4:184278109-184278139
  Hypo

SEQ ID NO: 123987 - DNA, 120 bp, Homo sapiens; identical to SEQ ID NO: 91958
  chr4:184375288-184375408
  Hypo

SEQ ID NO: 123988 - DNA, 18 bp, Homo sapiens
  chr4:184375708-184375726
  Hypo
ggccgatcctgcttcttt

SEQ ID NO: 123989 - DNA, 30 bp, Homo sapiens; identical to SEQ ID NO: 91960
  chr4:184532559-184532589
  Hypo

SEQ ID NO: 123990 - DNA, 36 bp, Homo sapiens; identical to SEQ ID NO: 91961
  chr4:184667629-184667665
  Hypo

SEQ ID NO: 123991 - DNA, 636 bp, Homo sapiens; identical to SEQ ID NO: 91962
  chr4:184718199-184718835
  Hyper

SEQ ID NO: 123992 - DNA, 213 bp, Homo sapiens; identical to SEQ ID NO: 91963
  chr4:184719200-184719413
  Hyper

SEQ ID NO: 123993 - DNA, 419 bp, Homo sapiens; identical to SEQ ID NO: 91964
  chr4:184826238-184826657
  Hyper

SEQ ID NO: 123994 - DNA, 213 bp, Homo sapiens; identical to SEQ ID NO: 91965
  chr4:184827078-184827291
  Hyper

SEQ ID NO: 123995 - DNA, 102 bp, Homo sapiens; identical to SEQ ID NO: 91966
  chr4:184827557-184827659
  Hyper

SEQ ID NO: 123996 - DNA, 120 bp, Homo sapiens
  chr4:184827940-184828060
  Hyper
accatgaagaagacccggagcacaaccttgcggcgagcctggcctagctcggatttctcggaccgggcctcggaccgcatgaggtcccgcagcgagaaggactaccgcctgcacaagcgt

SEQ ID NO: 123997 - DNA, 208 bp, Homo sapiens; identical to SEQ ID NO: 91967
  chr4:184921881-184922089
  Hypo

SEQ ID NO: 123998 - DNA, 339 bp, Homo sapiens; identical to SEQ ID NO: 91968
  chr4:185089642-185089981
  Hyper

SEQ ID NO: 123999 - DNA, 30 bp, Homo sapiens; identical to SEQ ID NO: 91969
  chr4:185592328-185592358
  Hypo

SEQ ID NO: 124000 - DNA, 30 bp, Homo sapiens; identical to SEQ ID NO: 40375
  chr4:185833058-185833088
  Hypo

SEQ ID NO: 124001 - DNA, 30 bp, Homo sapiens; identical to SEQ ID NO: 40376
  chr4:185913935-185913965
  Hypo

SEQ ID NO: 124002 - DNA, 30 bp, Homo sapiens; identical to SEQ ID NO: 91972
  chr4:185931321-185931351
  Hypo

SEQ ID NO: 124003 - DNA, 711 bp, Homo sapiens; identical to SEQ ID NO: 91973
  chr4:185937273-185937984
  Hyper

SEQ ID NO: 124004 - DNA, 717 bp, Homo sapiens; identical to SEQ ID NO: 91974
  chr4:185938230-185938947
  Hyper

SEQ ID NO: 124005 - DNA, 66 bp, Homo sapiens; identical to SEQ ID NO: 91975
  chr4:185939377-185939443
  Hyper

SEQ ID NO: 124006 - DNA, 3261 bp, Homo sapiens
  chr4:185939673-185942934
  Hyper
ctgcaggcgcttgctcgcccgccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaatcctatggaataattcaactcgtgaatgcatctggagccctagatgaccgctttataaggcagccctcggagttgggaggctgcagtctacctgggacactcgaggaggcacacgaggcggaaaagtggacgggtgccccgcgccaccgcctctcccgagggcgcgtactgaccaggatgtcagacaagctcaaggaacgcaaagtgagtcggctgagcccaaatggcacttgcgccctggtggtggaggcatctgactcaccgacccgccacttgggtggaccgatggcagggaagtgcccgcacgggactttgagtgtggaggaatctcgagtggtttgggaagggggtggggtagagagaggagggtgctcaaccaggtagaagtcctgcctggaggctggcggccacctccccaaaggcctgggtagggtggctggaaggggagcgcgccagcgcgggcgtcagaaggcagagctcacctggcccgagcgtggcgggccaggagtcccttcctagagcgaatctgagcagtgtgcgcggctggagaggcggcttgcacccagctgctagagccgcgcctttgacgacttcccgggcaaagccatcctaaacatacaaccctctcttcgcagagaacccccgtttctcataaagtgatagaaaagcggaggagggacaggatcaaccgctgcttgaacgagctgggcaagacagtgcccatggccttggcgaagcaggtaacgttggcgacccggagccgggtgccaggcgttgggaggcctctgcggccactctgcggagacgcccgagcccgcggacacagaggacctcacttgcgggcccctcccaggcggggggcctgagcgcagggcgaacctcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgttcagtacctgagagcactgcactccgctgattttccccggggaagggaaaaaggtgggcacaggttagggaatgggacgcctgggccaggcgcctgcgccacccagagaccctggggctgggaggggagtgactgagtgttcccgagagctctactagagctccactctccaggagggcaggggtcctgcgaaggcgcctctccctgctcggcgacagcaaggcggcgagggagaactggttcccagggaggctggttccacctccttctcccgggtggggtgggtggggtcaggctctcagggaaagagggcgtttgcgcgtgcctcgccagtctctaagactgcgcagaggagagggcgggcctcaaatgggaactttggccagaaaatgtggtgggaggtgccctgcacccgctttgggctcgcgtggggaaggggcactcagggtgtgtccgtcctacgggctttctcgttcctccagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggttcaggcagatattctaggcatcgcttaagggcgggattcgcggcttcctgcacccgccccatcttgagcattagcctcagagaaacaggggaggcgaagaacactgcccttggctctcaggaaaatgcaaattgaaggacctgccccaaactgacttaggcggaccgttgccagctgcgacccgggcgcccgtcctacccggagccaagtgcccgacgcgcgcgcaccgcacgcccgcgggtctggaatgcggcgaaacccgggccagcggggcgcgtggctgagtttacagaattaaaaatcctctaaaaaataccggaaccaagtacagttctgagttgcggattagaaacaacatcgttgatgacaactgctcagcgccagaggcttccgagaagctggcgttgccttttgcgcacagagcaggccagcttcgggggcgctgggcgtctcggcgagaggtcggcacctgccgggttgggagacgccccttccccaccccttaggggattgttccctacacgccatcctttaccattcggacactggtgcaggatggagaccctggggtctccgtttaagttctcaggcttggagagaaaagtcctccttatcctttccccagtgagatttttttttttatctcgccccacccagaacgtggtgaggaaagt

SEQ ID NO: 124007 - DNA, 30 bp, Homo sapiens; identical to SEQ ID NO: 91978
  chr4:185964663-185964693
  Hypo

SEQ ID NO: 124008 - DNA, 277 bp, Homo sapiens; identical to SEQ ID NO: 91979
  chr4:186048714-186048991
  Hyper

SEQ ID NO: 124009 - DNA, 572 bp, Homo sapiens; identical to SEQ ID NO: 91980
  chr4:186049493-186050065
  Hyper

SEQ ID NO: 124010 - DNA, 99 bp, Homo sapiens; identical to SEQ ID NO: 91981
  chr4:186347807-186347906
  Hypo

SEQ ID NO: 124011 - DNA, 161 bp, Homo sapiens; identical to SEQ ID NO: 40377
  chr4:186348467-186348628
  Hypo

SEQ ID NO: 124012 - DNA, 214 bp, Homo sapiens; identical to SEQ ID NO: 29342
  chr4:186456012-186456226
  Hyper

SEQ ID NO: 124013 - DNA, 198 bp, Homo sapiens; identical to SEQ ID NO: 91986
  chr4:186456727-186456925
  Hyper

SEQ ID NO: 124014 - DNA, 218 bp, Homo sapiens; identical to SEQ ID NO: 91987
  chr4:187026668-187026886
  Hyper

SEQ ID NO: 124015 - DNA, 30 bp, Homo sapiens; identical to SEQ ID NO: 91988
  chr4:187182190-187182220
  Hypo

SEQ ID NO: 124016 - DNA, 184 bp, Homo sapiens; identical to SEQ ID NO: 91989
  chr4:187459279-187459463
  Hypo

SEQ ID NO: 124017 - DNA, 30 bp, Homo sapiens; identical to SEQ ID NO: 91990
  chr4:187647639-187647669
  Hyper

SEQ ID NO: 124018 - DNA, 57 bp, Homo sapiens; identical to SEQ ID NO: 91991
  chr4:187648062-187648119
  Hyper

SEQ ID NO: 124019 - DNA, 30 bp, Homo sapiens
  chr4:188916851-188916881
  Hyper
agcctgattagaccgcgtcagtccggaggg

SEQ ID NO: 124020 - DNA, 18 bp, Homo sapiens
  chr4:189257706-189257724
  Hypo
gcccggccccccaactcc

SEQ ID NO: 124021 - DNA, 160 bp, Homo sapiens; identical to SEQ ID NO: 91994
  chr4:190474936-190475096
  Hypo

SEQ ID NO: 124022 - DNA, 30 bp, Homo sapiens; identical to SEQ ID NO: 91995
  chr4:190529509-190529539
  Hypo

SEQ ID NO: 124023 - DNA, 30 bp, Homo sapiens; identical to SEQ ID NO: 91996
  chr4:190536670-190536700
  Hypo

SEQ ID NO: 124024 - DNA, 30 bp, Homo sapiens; identical to SEQ ID NO: 91997
  chr4:190662219-190662249
  Hypo

SEQ ID NO: 124025 - DNA, 30 bp, Homo sapiens; identical to SEQ ID NO: 91998
  chr4:190763878-190763908
  Hypo

SEQ ID NO: 124026 - DNA, 950 bp, Homo sapiens
  chr5:53147-54097
  Hyper
aggtcagaacttgttcgggaccgccgggtggagacaaggacgcgggaacaaaacgtatgtgtgtgttggggggtgttgctgcgagagcgggcaagggcggggacgccgcgctgacccggtcctggatcccacccgcgctgggctcagggccgcgggttcgggtcctgccgggcgtcccacgcaccggggacgggcacgaaaccgtccacctgcctcagacctcggctgacctctgggccgcgggagggcccgagggtcttttccgcctctgctcgctgttgtgtctccaaggtcagaatccctgcggccggggctgcgcaaaacgccccccacccccgcctcactgccgcccccgagtccccttctcaggcaggctgtgggggttggggttgggcttcgcgagcccaagcggacgccgcaaagagaatgagaacctcggagcgctcggggcgggcgggcccagcccaggctcttcctacccctgcgggggtccgagggccagcggcatcggcggcgggaggagggggcgggggcggggaattagggggaggcgggtgttaaagaggagaagggcgggggcggagggggaggaggagacggggcggggaggacccccaggtttccgagtctccgcccgggctttcgttcccggctgtgtggccccgcgcggttcccgagcagctccaggaactgaaacgtgaaggggacctcggtgcccggagctgctgcccaggtaaccgcgctgcgcccggcgagcagatggggggtagtcgccccagtcctggactccgcgagggggcgcggggagtccacgctgcggccgcgcagacgggcggggcggttcgttcctgcgagcgccggaaccggggaggaggctggggaagagaaaggggcagaggggcgggcccgggggccggggccgagggggcggagcgcgaagtttccagagg

SEQ ID NO: 124027 - DNA, 166 bp, Homo sapiens; identical to SEQ ID NO: 94088
  chr5:54332-54498
  Hyper

SEQ ID NO: 124028 - DNA, 248 bp, Homo sapiens; identical to SEQ ID NO: 94413
  chr5:91876-92124
  Hyper

SEQ ID NO: 124029 - DNA, 36 bp, Homo sapiens; identical to SEQ ID NO: 40379
  chr5:109867-109903
  Hypo

SEQ ID NO: 124030 - DNA, 59 bp, Homo sapiens; identical to SEQ ID NO: 92991
  chr5:139686-139745
  Hypo

SEQ ID NO: 124031 - DNA, 30 bp, Homo sapiens; identical to SEQ ID NO: 92993
  chr5:139993-140023
  Hypo

SEQ ID NO: 124032 - DNA, 37 bp, Homo sapiens; identical to SEQ ID NO: 40381
  chr5:140350-140387
  Hypo

SEQ ID NO: 124033 - DNA, 134 bp, Homo sapiens; identical to SEQ ID NO: 93704
  chr5:192173-192307
  Hypo

SEQ ID NO: 124034 - DNA, 1764 bp, Homo sapiens
  chr5:320654-322418
  Hyper
agacttttcctgagccgacagcagacagcgagtgcaaaggccccaaggcccgcacgccttattcagagaacagcaggaggcgcggggcgggttgggggcgtcagggagacggggtttgactgagaacctgggggcgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagctcaggatccaaaagcatcttaatattctctataattcgccaaaaaccatgactccttttacattttcgaaacgacctcatggggcaggcgagggggcacacgctctcctcactttacctgttcgggtctacaccgcccggctctagggccggcagctcagcacagccggccgcgagcgctggggaggggacgggggcgcagggagaaccgggggaccctgggcgcacacagaccccagggggaacgcagggcctggaggggctcagcgcgcgacccccgcctcggggcacggagactccgggggatcactgggacgcgaagggcgcagggcggaccccaggggaaccggatggcgtctccggttcgccagggcagctggggcagccggacccgagacagccggacccgcgggcgccctctgccgcctcccggccctggatgctgcggggcggggcgggcggctcgcgtgccggggtggggcagtccctggagccgccgcgggttcccgggatgcgagcgccggcacccgccgccacagctcctggccagggcgcgctgccccgcgggtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctcacgccgcatcctcgcgtcgccaggcccggcggccccgggacggggcggacactctggggtgcggctggctggtctcacttaaaactcggacctcggagggaagccgcggcgcgtccacggttcgtggtcctcagcgtcccctcgagagtgttctgagccttcactccccgggcgttccgtgcgggccgcgctccctggggctgggcgggtgcgggcggcggagcggggccccgctgtcgggccgagggcgccaggtccggggggcctcacccccgggaaaggcccatgttcaggcttggtttcagtagcacccagtagcgctgaagtcttattttgagcggccagaattcccagaccggatgccctgagag

SEQ ID NO: 124035 - DNA, 262 bp, Homo sapiens; identical to SEQ ID NO: 93857
  chr5:344035-344297
  Hyper

SEQ ID NO: 124036 - DNA, 33 bp, Homo sapiens; identical to SEQ ID NO: 93869
  chr5:353889-353922
  Hypo

SEQ ID NO: 124037 - DNA, 30 bp, Homo sapiens; identical to SEQ ID NO: 93882
  chr5:359746-359776
  Hypo

SEQ ID NO: 124038 - DNA, 276 bp, Homo sapiens; identical to SEQ ID NO: 93910
  chr5:374077-374353
  Hyper

SEQ ID NO: 124039 - DNA, 30 bp, Homo sapiens; identical to SEQ ID NO: 93934
  chr5:386774-386804
  Hypo

SEQ ID NO: 124040 - DNA, 130 bp, Homo sapiens; identical to SEQ ID NO: 93940
  chr5:398801-398931
  Hypo

SEQ ID NO: 124041 - DNA, 32 bp, Homo sapiens; identical to SEQ ID NO: 93941
  chr5:400157-400189
  Hyper

SEQ ID NO: 124042 - DNA, 30 bp, Homo sapiens; identical to SEQ ID NO: 93951
  chr5:411982-412012
  Hypo

SEQ ID NO: 124043 - DNA, 30 bp, Homo sapiens; identical to SEQ ID NO: 93959
  chr5:423138-423168
  Hypo

SEQ ID NO: 124044 - DNA, 30 bp, Homo sapiens; identical to SEQ ID NO: 93963
  chr5:427604-427634
  Hypo

SEQ ID NO: 124045 - DNA, 33 bp, Homo sapiens; identical to SEQ ID NO: 93966
  chr5:427958-427991
  Hypo

SEQ ID NO: 124046 - DNA, 126 bp, Homo sapiens; identical to SEQ ID NO: 93972
  chr5:429675-429801
  Hypo

SEQ ID NO: 124047 - DNA, 331 bp, Homo sapiens; identical to SEQ ID NO: 93980
  chr5:430042-430373
  Hypo

SEQ ID NO: 124048 - DNA, 96 bp, Homo sapiens; identical to SEQ ID NO: 93999
  chr5:435478-435574
  Hypo

SEQ ID NO: 124049 - DNA, 30 bp, Homo sapiens; identical to SEQ ID NO: 94019
  chr5:465822-465852
  Hypo

SEQ ID NO: 124050 - DNA, 30 bp, Homo sapiens; identical to SEQ ID NO: 94020
  chr5:475028-475058
  Hyper

SEQ ID NO: 124051 - DNA, 54 bp, Homo sapiens; identical to SEQ ID NO: 94021
  chr5:478158-478212
  Hypo

SEQ ID NO: 124052 - DNA, 298 bp, Homo sapiens; identical to SEQ ID NO: 94022
  chr5:479376-479674
  Hypo

SEQ ID NO: 124053 - DNA, 39 bp, Homo sapiens; identical to SEQ ID NO: 94023
  chr5:480581-480620
  Hypo

SEQ ID NO: 124054 - DNA, 164 bp, Homo sapiens; identical to SEQ ID NO: 14710
  chr5:480880-481044
  Hypo

SEQ ID NO: 124055 - DNA, 38 bp, Homo sapiens; identical to SEQ ID NO: 94025
  chr5:484540-484578
  Hypo

SEQ ID NO: 124056 - DNA, 46 bp, Homo sapiens; identical to SEQ ID NO: 94028
  chr5:487718-487764
  Hypo

SEQ ID NO: 124057 - DNA, 58 bp, Homo sapiens; identical to SEQ ID NO: 94030
  chr5:488495-488553
  Hypo

SEQ ID NO: 124058 - DNA, 146 bp, Homo sapiens; identical to SEQ ID NO: 40391
  chr5:488846-488992
  Hypo

SEQ ID NO: 124059 - DNA, 64 bp, Homo sapiens; identical to SEQ ID NO: 94032
  chr5:490702-490766
  Hypo

SEQ ID NO: 124060 - DNA, 948 bp, Homo sapiens; identical to SEQ ID NO: 94033
  chr5:491223-492171
  Hypo

SEQ ID NO: 124061 - DNA, 30 bp, Homo sapiens; identical to SEQ ID NO: 94036
  chr5:500270-500300
  Hypo

SEQ ID NO: 124062 - DNA, 30 bp, Homo sapiens; identical to SEQ ID NO: 94037
  chr5:500505-500535
  Hypo

SEQ ID NO: 124063 - DNA, 146 bp, Homo sapiens; identical to SEQ ID NO: 94048
  chr5:506753-506899
  Hypo

SEQ ID NO: 124064 - DNA, 197 bp, Homo sapiens; identical to SEQ ID NO: 40393
  chr5:516758-516955
  Hypo

SEQ ID NO: 124065 - DNA, 30 bp, Homo sapiens; identical to SEQ ID NO: 40394
  chr5:519988-520018
  Hypo

SEQ ID NO: 124066 - DNA, 1102 bp, Homo sapiens
  chr5:523778-524880
  Hyper
ctgctgggtttcatgcgggtagcaccgcttttcttttctgcccttgtaactcacgaaaaaacgccatcactccaaggacgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctgggatgcccgggcagctgtgggt

SEQ ID NO: 124067 - DNA, 284 bp, Homo sapiens
  chr5:528599-528883
  Hyper
ccatgggcctctctccgcatccgcatgtgcatccgcaaccgcttccgtcccgctgagcgcacgaaccctctcgctcctgtccctcccgccccgcccgccccgcccgccccggacgcctctgctgcggtgtcttagcggtccgcggacaggcgacctcccccgtggacgcccctctcccggccgccgccccgccccgcgccccgctcccccgcgcccctgggccgagacctccggtcgcctcgccccgtctccggccacgaaaggcgctgcggacctggcggtca

SEQ ID NO: 124068 - DNA, 88 bp, Homo sapiens; identical to SEQ ID NO: 94081
  chr5:537288-537376
  Hypo

SEQ ID NO: 124069 - DNA, 193 bp, Homo sapiens; identical to SEQ ID NO: 94082
  chr5:537854-538047
  Hypo

SEQ ID NO: 124070 - DNA, 370 bp, Homo sapiens; identical to SEQ ID NO: 94083
  chr5:538581-538951
  Hypo

SEQ ID NO: 124071 - DNA, 272 bp, Homo sapiens; identical to SEQ ID NO: 94098
  chr5:554299-554571
  Hypo

SEQ ID NO: 124072 - DNA, 120 bp, Homo sapiens; identical to SEQ ID NO: 94099
  chr5:554631-554751
  Hypo

SEQ ID NO: 124073 - DNA, 120 bp, Homo sapiens; identical to SEQ ID NO: 94100
  chr5:554811-554931
  Hypo

SEQ ID NO: 124074 - DNA, 151 bp, Homo sapiens; identical to SEQ ID NO: 94101
  chr5:555171-555322
  Hypo

SEQ ID NO: 124075 - DNA, 789 bp, Homo sapiens; identical to SEQ ID NO: 94102
  chr5:555668-556457
  Hypo

SEQ ID NO: 124076 - DNA, 30 bp, Homo sapiens; identical to SEQ ID NO: 94107
  chr5:559409-559439
  Hypo

SEQ ID NO: 124077 - DNA, 71 bp, Homo sapiens; identical to SEQ ID NO: 94114
  chr5:583170-583241
  Hypo

SEQ ID NO: 124078 - DNA, 30 bp, Homo sapiens; identical to SEQ ID NO: 40403
  chr5:595300-595330
  Hypo

SEQ ID NO: 124079 - DNA, 85 bp, Homo sapiens; identical to SEQ ID NO: 94129
  chr5:601137-601222
  Hypo

SEQ ID NO: 124080 - DNA, 58 bp, Homo sapiens; identical to SEQ ID NO: 94132
  chr5:602421-602479
  Hypo

SEQ ID NO: 124081 - DNA, 30 bp, Homo sapiens; identical to SEQ ID NO: 94149
  chr5:643539-643569
  Hypo

SEQ ID NO: 124082 - DNA, 112 bp, Homo sapiens; identical to SEQ ID NO: 94167
  chr5:675631-675743
  Hypo

SEQ ID NO: 124083 - DNA, 158 bp, Homo sapiens; identical to SEQ ID NO: 94171
  chr5:676768-676926
  Hypo

SEQ ID NO: 124084 - DNA, 464 bp, Homo sapiens; identical to SEQ ID NO: 94172
  chr5:677630-678094
  Hypo

SEQ ID NO: 124085 - DNA, 54 bp, Homo sapiens; identical to SEQ ID NO: 40407
  chr5:684241-684295
  Hypo

SEQ ID NO: 124086 - DNA, 136 bp, Homo sapiens; identical to SEQ ID NO: 94180
  chr5:697176-697312
  Hypo

SEQ ID NO: 124087 - DNA, 206 bp, Homo sapiens; identical to SEQ ID NO: 94363
  chr5:851688-851894
  Hypo

SEQ ID NO: 124088 - DNA, 622 bp, Homo sapiens; identical to SEQ ID NO: 94409
  chr5:891065-891687
  Hypo

SEQ ID NO: 124089 - DNA, 353 bp, Homo sapiens
  chr5:926707-927060
  Hyper
cgcttcttccccgcccgcccctcctgggcccctcgcgtcccccttccctgtcacccgagcttcgtttgtgactgaaactctgctgcgtctgtcatcttggtgtcctctatgaaaaccttcccagagctcttcacactccacacgtggcttttatttagtgttttctacctactcggcagcgtttcctggggagggaaggcacccagagcctccggagccacgcggcgctgtgttcccgcgccctcggcttccctgttgctcagggttatttcttcctgccatcagctggagaagcgctctccgaatatttccccgggaacgcggacttgccggccctgcgaggcacccggcgg

SEQ ID NO: 124090 - DNA, 173 bp, Homo sapiens; identical to SEQ ID NO: 94426
  chr5:931145-931318
  Hypo

SEQ ID NO: 124091 - DNA, 95 bp, Homo sapiens; identical to SEQ ID NO: 40410
  chr5:1003105-1003200
  Hypo

SEQ ID NO: 124092 - DNA, 30 bp, Homo sapiens; identical to SEQ ID NO: 92698
  chr5:1007449-1007479
  Hypo

SEQ ID NO: 124093 - DNA, 43 bp, Homo sapiens; identical to SEQ ID NO: 92699
  chr5:1008040-1008083
  Hypo

SEQ ID NO: 124094 - DNA, 367 bp, Homo sapiens; identical to SEQ ID NO: 92700
  chr5:1009258-1009625
  Hyper

SEQ ID NO: 124095 - DNA, 177 bp, Homo sapiens; identical to SEQ ID NO: 92705
  chr5:1021313-1021490
  Hypo

SEQ ID NO: 124096 - DNA, 30 bp, Homo sapiens; identical to SEQ ID NO: 92712
  chr5:1028378-1028408
  Hypo

SEQ ID NO: 124097 - DNA, 62 bp, Homo sapiens; identical to SEQ ID NO: 92715
  chr5:1033612-1033674
  Hypo

SEQ ID NO: 124098 - DNA, 431 bp, Homo sapiens; identical to SEQ ID NO: 92716
  chr5:1034304-1034735
  Hypo

SEQ ID NO: 124099 - DNA, 30 bp, Homo sapiens; identical to SEQ ID NO: 92717
  chr5:1037486-1037516
  Hypo

SEQ ID NO: 124100 - DNA, 40 bp, Homo sapiens; identical to SEQ ID NO: 92718
  chr5:1037995-1038035
  Hypo

SEQ ID NO: 124101 - DNA, 126 bp, Homo sapiens; identical to SEQ ID NO: 92719
  chr5:1039154-1039280
  Hypo

SEQ ID NO: 124102 - DNA, 70 bp, Homo sapiens; identical to SEQ ID NO: 92720
  chr5:1039613-1039683
  Hypo

SEQ ID NO: 124103 - DNA, 909 bp, Homo sapiens; identical to SEQ ID NO: 92736
  chr5:1073480-1074389
  Hypo

SEQ ID NO: 124104 - DNA, 30 bp, Homo sapiens; identical to SEQ ID NO: 92740
  chr5:1094019-1094049
  Hypo

SEQ ID NO: 124105 - DNA, 91 bp, Homo sapiens; identical to SEQ ID NO: 92746
  chr5:1104793-1104884
  Hyper

SEQ ID NO: 124106 - DNA, 37 bp, Homo sapiens; identical to SEQ ID NO: 92757
  chr5:1118984-1119021
  Hypo

SEQ ID NO: 124107 - DNA, 36 bp, Homo sapiens; identical to SEQ ID NO: 92761
  chr5:1122889-1122925
  Hypo

SEQ ID NO: 124108 - DNA, 164 bp, Homo sapiens; identical to SEQ ID NO: 92767
  chr5:1131227-1131391
  Hypo

SEQ ID NO: 124109 - DNA, 30 bp, Homo sapiens; identical to SEQ ID NO: 92786
  chr5:1151152-1151182
  Hypo

SEQ ID NO: 124110 - DNA, 884 bp, Homo sapiens; identical to SEQ ID NO: 92795
  chr5:1155674-1156558
  Hyper

SEQ ID NO: 124111 - DNA, 30 bp, Homo sapiens; identical to SEQ ID NO: 92804
  chr5:1169521-1169551
  Hypo

SEQ ID NO: 124112 - DNA, 125 bp, Homo sapiens; identical to SEQ ID NO: 5026
  chr5:1174263-1174388
  Hypo

SEQ ID NO: 124113 - DNA, 149 bp, Homo sapiens; identical to SEQ ID NO: 92807
  chr5:1189557-1189706
  Hypo

SEQ ID NO: 124114 - DNA, 30 bp, Homo sapiens; identical to SEQ ID NO: 40418
  chr5:1193360-1193390
  Hypo

SEQ ID NO: 124115 - DNA, 249 bp, Homo sapiens; identical to SEQ ID NO: 92814
  chr5:1193747-1193996
  Hypo

SEQ ID NO: 124116 - DNA, 67 bp, Homo sapiens; identical to SEQ ID NO: 92815
  chr5:1196184-1196251
  Hypo

SEQ ID NO: 124117 - DNA, 30 bp, Homo sapiens; identical to SEQ ID NO: 92819
  chr5:1210123-1210153
  Hypo

SEQ ID NO: 124118 - DNA, 30 bp, Homo sapiens; identical to SEQ ID NO: 92820
  chr5:1210355-1210385
  Hypo

SEQ ID NO: 124119 - DNA, 162 bp, Homo sapiens; identical to SEQ ID NO: 92821
  chr5:1213550-1213712
  Hypo

SEQ ID NO: 124120 - DNA, 30 bp, Homo sapiens; identical to SEQ ID NO: 92826
  chr5:1218808-1218838
  Hypo

SEQ ID NO: 124121 - DNA, 223 bp, Homo sapiens; identical to SEQ ID NO: 92827
  chr5:1221121-1221344
  Hypo

SEQ ID NO: 124122 - DNA, 37 bp, Homo sapiens; identical to SEQ ID NO: 40421
  chr5:1223271-1223308
  Hypo

SEQ ID NO: 124123 - DNA, 82 bp, Homo sapiens; identical to SEQ ID NO: 92846
  chr5:1228694-1228776
  Hypo

SEQ ID NO: 124124 - DNA, 472 bp, Homo sapiens; identical to SEQ ID NO: 92847
  chr5:1232819-1233291
  Hypo

SEQ ID NO: 124125 - DNA, 30 bp, Homo sapiens; identical to SEQ ID NO: 92854
  chr5:1245053-1245083
  Hypo

SEQ ID NO: 124126 - DNA, 30 bp, Homo sapiens; identical to SEQ ID NO: 92855
  chr5:1254554-1254584
  Hypo

SEQ ID NO: 124127 - DNA, 30 bp, Homo sapiens; identical to SEQ ID NO: 92865
  chr5:1264364-1264394
  Hypo

SEQ ID NO: 124128 - DNA, 30 bp, Homo sapiens; identical to SEQ ID NO: 92868
  chr5:1272253-1272283
  Hypo

SEQ ID NO: 124129 - DNA, 31 bp, Homo sapiens; identical to SEQ ID NO: 92880
  chr5:1291862-1291893
  Hypo

SEQ ID NO: 124130 - DNA, 144 bp, Homo sapiens; identical to SEQ ID NO: 92885
  chr5:1294182-1294326
  Hypo

SEQ ID NO: 124131 - DNA, 671 bp, Homo sapiens
  chr5:1294543-1295214
  Hyper
gcaggtgaaccagcacgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggct

SEQ ID NO: 124132 - DNA, 454 bp, Homo sapiens
  chr5:1295265-1295719
  Hyper
gcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggccgcgcttccccgcccgcgcgccgctcgcgctcccagggtgcagggacgccagcgagggccccagcggagagaggtcgaatcggcctaggctgtggggtaacccgagggaggggccatgatgtggaggccctgggaacaggtgcgtgcggcgaccctttggccgctggcctgatccggagacccagggctgcctccaggtccggacgcggggcgtcgggctccgggcaccacgaatgccggacgtgaaggggaggacggaggcgcgtagacgcggct

SEQ ID NO: 124133 - DNA, 166 bp, Homo sapiens; identical to SEQ ID NO: 92929
  chr5:1346140-1346306
  Hypo

SEQ ID NO: 124134 - DNA, 50 bp, Homo sapiens; identical to SEQ ID NO: 40424
  chr5:1346659-1346709
  Hypo

SEQ ID NO: 124135 - DNA, 28 bp, Homo sapiens
  chr5:1356625-1356653
  Hypo
cggctcacgtggccacggagcagcaccg

SEQ ID NO: 124136 - DNA, 182 bp, Homo sapiens; identical to SEQ ID NO: 92953
  chr5:1357154-1357336
  Hypo

SEQ ID NO: 124137 - DNA, 186 bp, Homo sapiens; identical to SEQ ID NO: 92954
  chr5:1362617-1362803
  Hypo

SEQ ID NO: 124138 - DNA, 30 bp, Homo sapiens; identical to SEQ ID NO: 92966
  chr5:1379058-1379088
  Hypo

SEQ ID NO: 124139 - DNA, 38 bp, Homo sapiens; identical to SEQ ID NO: 92968
  chr5:1381049-1381087
  Hypo

SEQ ID NO: 124140 - DNA, 97 bp, Homo sapiens; identical to SEQ ID NO: 92969
  chr5:1381147-1381244
  Hypo

SEQ ID NO: 124141 - DNA, 75 bp, Homo sapiens; identical to SEQ ID NO: 92971
  chr5:1384936-1385011
  Hypo

SEQ ID NO: 124142 - DNA, 170 bp, Homo sapiens; identical to SEQ ID NO: 93022
  chr5:1406427-1406597
  Hypo

SEQ ID NO: 124143 - DNA, 68 bp, Homo sapiens; identical to SEQ ID NO: 93051
  chr5:1422073-1422141
  Hypo

SEQ ID NO: 124144 - DNA, 30 bp, Homo sapiens; identical to SEQ ID NO: 93058
  chr5:1429032-1429062
  Hypo

SEQ ID NO: 124145 - DNA, 30 bp, Homo sapiens; identical to SEQ ID NO: 93059
  chr5:1429795-1429825
  Hypo

SEQ ID NO: 124146 - DNA, 213 bp, Homo sapiens; identical to SEQ ID NO: 93060
  chr5:1431070-1431283
  Hypo

SEQ ID NO: 124147 - DNA, 607 bp, Homo sapiens
  chr5:1444675-1445282
  Hyper
tcacgagctatgccacgcacccggtgacaacctcaaccggcacgacccctccggtgggtaaaacacccgacgaaggggttccgcggcgcgagcaggaggccgcgttgggagagggcgtcgggtgcggagctcgcgagtctccggcaagccgccgccgccctggggccacctgaccccgctcctgaacgcggggcctcagaggcgagttttgggtctacacagcaaaatgtggcccgttagaaagcgtccttcctcaccgcgcccagaacaagaagcggcgctgcctggcgagtcctcgcccggcctccccgccctgcccagagcaccagcgcgcagcccgcgcccgccaccacccccaacacagacaaagcccccgcgagatggagcggcggtgtacaaaacccactccgatcggatctgggatgcgccgcacccctagtagggttaagttccacgagaagaaaccaggacccccgagtcacagccatagacacccacgcgtcccctaagccggtgactgcaccaggtgcccacccggttctgagcctggagcggggccaggggcagccctgcaccctcctcgcgcctcggacggcctcagggtccc

SEQ ID NO: 124148 - DNA, 1114 bp, Homo sapiens
  chr5:1445485-1446599
  Hyper
gcacgcgagtcctggcgccgagagcgttccgcgaagcctcccctcccgctccgcagcgctgggcggtctcagcctcggcctcgggctcttatccagtagacagggtccgccccgccccgccctcccgccgacggggtcgccctcgcgtcctggctcctcctcctcacctccccgggccgcgcccccgcccccgcctcccggacgcagatggctgggagcaagcggcggccacggctccactgtcctgcgcgtcccggagcctcggacacggggtgcgggggcctgggggtccgagacgtcgcggatctagacgggcgccttccacgcgggaactgtctgggccgccctgcgccctcgcccgcacccctgggggctgccccgggcacccgctatcttcggacgcccagggctggcggctcccagctggacggggagggagccgagcggctgcgcgcggggaactgctgggaccccgtcgggccgacccttccctccctccccatcaggggcccctacggtggccccgcgctctggggaccacgtccctcccaccccgccgctccacgctctgaccagcgggctcgggaccccgccgaggactctgcacgcttcccggcgtgcgggctgcggagacgcgggtccttccgtggccttggggtctccgcgacctcgaggcgaccgaggtcccctaggcctagtccccgccttgccggcatctagtgcgcctgcatcggaaccgaggggcccgcctcgcactcgcctaagaaaaccatttcccgggacgggcctggaaagccctggcggttggtatccggctccagggccgaatggactccgaggctttccttccgagatgcccgggcgggatttcttccattcagcgcgcggaggaatggagcccccaggccgccaaggcccaggatgtccaggtccttagaaggcaccgaggtgagtggccgcgcccagctctgtgcgtcgcccctagggtcgcccgaaccccggcgttcctccccgtgtaccctcgatgctcccgtgagcaccctgccctgggcgtccaggcgagccctggggctctccagccattccagcctgcagcccgcgctcagcagtgagg

SEQ ID NO: 124149 - DNA, 180 bp, Homo sapiens; identical to SEQ ID NO: 93176
  chr5:1549177-1549357
  Hypo

SEQ ID NO: 124150 - DNA, 35 bp, Homo sapiens; identical to SEQ ID NO: 93186
  chr5:1563387-1563422
  Hypo

SEQ ID NO: 124151 - DNA, 91 bp, Homo sapiens; identical to SEQ ID NO: 93255
  chr5:1654294-1654385
  Hyper

SEQ ID NO: 124152 - DNA, 330 bp, Homo sapiens; identical to SEQ ID NO: 93256
  chr5:1662561-1662891
  Hypo

SEQ ID NO: 124153 - DNA, 580 bp, Homo sapiens
  chr5:1667514-1668094
  Hyper
cgttgccctgggaaccggggactgcagccgcggacttcggggtctcggctccggcccctgcaggaccgcgggcgccgccggggaagcgaggcctttgggtctgagggtccgagcggctcccggaggtgcgggcggagataggagaccccccccgagcctggggggggcgcaggaagggggcgcgcggggcgggggcgcgcaggaagggggcgcgcggggcgggggcgcgcgttctccctccgggcagcctcgtgggcggtagatgcagccaacgcgtccgtcaaagcggttcaggggcgctgggaagaggcggcggtgaccccgggacggcagtgggcccgaccgagcctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaactccgcgttcccacctccag

SEQ ID NO: 124154 - DNA, 146 bp, Homo sapiens; identical to SEQ ID NO: 93265
  chr5:1668306-1668452
  Hyper

SEQ ID NO: 124155 - DNA, 42 bp, Homo sapiens; identical to SEQ ID NO: 93325
  chr5:1704607-1704649
  Hypo

SEQ ID NO: 124156 - DNA, 30 bp, Homo sapiens; identical to SEQ ID NO: 93386
  chr5:1726678-1726708
  Hypo

SEQ ID NO: 124157 - DNA, 71 bp, Homo sapiens; identical to SEQ ID NO: 93404
  chr5:1729815-1729886
  Hypo

SEQ ID NO: 124158 - DNA, 36 bp, Homo sapiens; identical to SEQ ID NO: 93406
  chr5:1730216-1730252
  Hypo

SEQ ID NO: 124159 - DNA, 1175 bp, Homo sapiens; identical to SEQ ID NO: 93431
  chr5:1746002-1747177
  Hypo

SEQ ID NO: 124160 - DNA, 90 bp, Homo sapiens; identical to SEQ ID NO: 93435
  chr5:1749854-1749944
  Hypo

SEQ ID NO: 124161 - DNA, 37 bp, Homo sapiens; identical to SEQ ID NO: 93437
  chr5:1750588-1750625
  Hypo

SEQ ID NO: 124162 - DNA, 30 bp, Homo sapiens; identical to SEQ ID NO: 93489
  chr5:1764822-1764852
  Hypo

SEQ ID NO: 124163 - DNA, 30 bp, Homo sapiens; identical to SEQ ID NO: 93532
  chr5:1779736-1779766
  Hypo

SEQ ID NO: 124164 - DNA, 30 bp, Homo sapiens; identical to SEQ ID NO: 40438
  chr5:1780761-1780791
  Hypo

SEQ ID NO: 124165 - DNA, 178 bp, Homo sapiens; identical to SEQ ID NO: 93610
  chr5:1794492-1794670
  Hypo

SEQ ID NO: 124166 - DNA, 32 bp, Homo sapiens; identical to SEQ ID NO: 93611
  chr5:1794976-1795008
  Hypo

SEQ ID NO: 124167 - DNA, 228 bp, Homo sapiens; identical to SEQ ID NO: 40440
  chr5:1795233-1795461
  Hypo

SEQ ID NO: 124168 - DNA, 105 bp, Homo sapiens; identical to SEQ ID NO: 93675
  chr5:1827709-1827814
  Hypo

SEQ ID NO: 124169 - DNA, 30 bp, Homo sapiens; identical to SEQ ID NO: 93677
  chr5:1839565-1839595
  Hypo

SEQ ID NO: 124170 - DNA, 62 bp, Homo sapiens; identical to SEQ ID NO: 93678
  chr5:1844450-1844512
  Hypo

SEQ ID NO: 124171 - DNA, 51 bp, Homo sapiens; identical to SEQ ID NO: 93679
  chr5:1851149-1851200
  Hyper

SEQ ID NO: 124172 - DNA, 599 bp, Homo sapiens
  chr5:1851402-1852001
  Hyper
tgctactccaggggccgcgccagcagcattttcccaggcagccggtcgtcatcctcctccctgcagcctcctcctgcgccctctcacgaggcgctggggcctggtgcggaaggatttacagggaaggaatgtcgggctcctccggctgggagcgcacctgcgcagggagggtcctgtcccaccacacctggccccctggggaacagcgggtgagtgctgctgcaggaaggagcaggagagacgcactgctccccgctcctctctccgcttccctcctctcctcccacctcccccatctcctccgtcccctgtctccgcccctccttgtcctcaggaagccatatcccactctggtggagtggctcaggccgctgatgagggtgctcggggcagggctcttctctgagtgacgttggaggttttcacggtgaacacagaaaggggcactccgtccgagctgagcctcagggaccgtgaggcttgctcttggccctgctgctcatacagccctccgtgcctcgcttccctcccacagcaaggaaggatgacgggtgcggggtctgcacggtggcgcggggtggccgcgttgctcaggaggc

SEQ ID NO: 124173 - DNA, 220 bp, Homo sapiens; identical to SEQ ID NO: 93682
  chr5:1865538-1865758
  Hypo

SEQ ID NO: 124174 - DNA, 34 bp, Homo sapiens; identical to SEQ ID NO: 40442
  chr5:1869209-1869243
  Hypo

SEQ ID NO: 124175 - DNA, 2340 bp, Homo sapiens
  chr5:1874892-1877232
  Hyper
aatggaatcatcagccgcggtttgagaggtcgataaagcttttagatttggagacgttttccgggagcccatttcctgcggctaagagttgttaatggagcttaaggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcccgccgcagccttttgacaggcacatgagccgcgagcttccgaacctcgataatatcatctcgagcgcgaaagtcaatacggtgacagcgcgcggccggatacaatccaattacgctcggctgcccgggcgctcctggggctcggggtccggcggccgagggtccccctcagggcccggtccaggccctgtcgccagggttcagggcaggccccaccacgcgggggactttggtggcccaggggtccccacgaggccgcagtccgggtccgcccagccccaggctcctagaggaaagccgagcctagtgagtccctccaaggccgcccgcccgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggggatggggaggggagcccggatttctgagcgtagccacggcttggccgggccccccgagccccggatcgctccgcgggttccttccacacgcccttcccgccctgccccgaggcctttcctcccagtcccgcctccggtcggcggcctgtgaagctctgagcatttccccccgcggagccgcggctcgccggctttccgagcagagctgattgcggagcggcgggtccccggaaataggagagccgaggttaggaggtggctgagacggcagaggcgtcgaggccgccctaactcctgcctaggatgggcagaggccgctaacagagaaaagcaacgatgggctcccacgcccccccccgggacacggctctg

SEQ ID NO: 124176 - DNA, 1291 bp, Homo sapiens
  chr5:1877754-1879045
  Hyper
gcttcagaacggaaccgccttctccatgtaaacttttgacgtaaactttatgcttcagggtatctggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagtcggcgccgtccgcctgagcgcgggttccctcctgggctcgggacccgcccgcctcaggcgcagaagggtttgccgccggccttgggcagggcgagcagctccctggcggcgcctgcagctggggcgtcctggggcacggcaggcggaaaggcgcgggccaggggtgcagtcagcacgttcgcgcccgcccccagcgagcgtcccagaggcccggggtccaggagggcgcccttggcggtggcccaggcctggttcaaagtgctgtgcctgaggatggggtcgtggaagaccccgtccacccagtttctgagactggttaccggggagtcctggtgcctgtccagggcgccagagtggggaagggccacagacggggacgtggcgggcgcggaggacacagccgcaggggccgcgggaccttggcgcttgagcatgcacgacggaaactcagtctggctcagggaggtggcggcggcggcggcggcggtggctgtgtgggccagggaccagatgcgcggcttagcctccaggcctgccgacgcccccgccggcacaaaccccagcttggcctcgcagacctgagggccgccctctgcgcccggcagtggctccggcccggccgccgcgctgcggagacagctccgggccctctccaggtcctcgtccagagcagctccgccacccgcggccagagacatccggagcgcgcctgaggcctccttgaccgggccgtcgggcgcggcggggacgcgctccagaccgccgtccagggagtggaagggcggcttcagctcgcacgccggcggctctgcttccagcgggtcgaagtcgtccaagtcactaagctccagctccttctcctctttgcccacgggctctgcgggagagaatgcgtggccagtggagggagagggttggtaggtgaatcagaccccctgtccccgtccaccattatgaggcctgttcccgacgctacgaaaagcactcggggcctctcttcgcgtctcccatttcct

SEQ ID NO: 124177 - DNA, 241 bp, Homo sapiens
  chr5:1879506-1879747
  Hyper
cctaggcatggggctcggcgtttgggacccccaagacgtcctagaaccgcagagaaggcactgtgcctgcactccagggcctcagcccccagtgacaacctcccaacccacctgcgttcttggagctcttgaggggctcctcccgcgcctcctcctcgcccccctcctcctcctcgccctccgcgtagggccgcttctcgtctgcgcacttgttccgcggcggccacgtcatcttgttctc

SEQ ID NO: 124178 - DNA, 3546 bp, Homo sapiens
  chr5:1882184-1885730
  Hyper
ggccgcgaggactggcgggaagccgggctggaggctggggccctgggccttgccaatcccgcgcgccgcccacgagggcgtgccccgagtacccccgggcctcccgccgtccacaccaggatgctcgcccctttccactagcttgtgcgcgtctggcctcctccgccacgtggggcccagccgagcacctacacccttccccggagggtttccaaggcctctgacgccatttgcgcgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtcttttaagttcccgctcagcccaccgcccccacctcgcctccccgactttcctccccgatcccctttccgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggc

SEQ ID NO: 124179 - DNA, 2113 bp, Homo sapiens
  chr5:1885934-1888047
  Hyper
tgtccctttcaccaacgataggacgctcagcatctcaggtatcagctgaacgcgtctgcatagactcggagtgctgagccttcctccctctagggacccccggtactaaatacacccgtgagcaggtgggccagaagtcagccggctcccggagtacacagcaccggctcagcttcggggagatgaggtgctcccgctggcctggagcgctccgaagagcggaggaccagggccggagcaggccgcaggggaggcaggggatggtcagcccctaacgcgaagcgcaggcgggtcgcctattttgacggggttaccgttggccgtcggaaccatggaaggcctccggggagacaggccgggccctgacccttcttcggccagcctagccctggtgcttcaggagttaccctgggggccaccagttccccgcaccaagagctcgtccggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccggggcgggggcgggagcgggggacctcacctacctgcggtggcgctgggccgctcccggcagcccgcgagggctccgcgcggaagctcggcgcgcgcgctccagcggggagccggcgacaactaatggagacatttccaggcggagcacctggcgagcggagcgcgccggcgtccccaggcgccgcggtcgtcagccgagcccgcaccggcgtgacgtgggcgagcgagcgcgctgctcccacccggccgcccattaacgctttctcccgcgggcgccgcgctcttgccaactttcccctccgtccggtctgcgcgcggcgcgccgggtgcaggagctggggtgagggcgccccgggtgccagcaggggcgctgggagctgtttgggcggggacgtagggctccgggaggtcacacagccctaacaggacagtgggaaggcgcgcgagccagatttggccaaacgctaagctcgctgcggcctcgggccctcggcccacggggcccctctccccgtttgggctgccccacccagggacgcttgggccgggcgcgaagagcccggaaatagccacccttgtcgtcggcccggtttccctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggtgataagccgcccgaggaccaat

SEQ ID NO: 124180 - DNA, 35 bp, Homo sapiens; identical to SEQ ID NO: 93702
  chr5:1892071-1892106
  Hypo

SEQ ID NO: 124181 - DNA, 135 bp, Homo sapiens; identical to SEQ ID NO: 93703
  chr5:1913952-1914087
  Hypo

SEQ ID NO: 124182 - DNA, 87 bp, Homo sapiens; identical to SEQ ID NO: 93705
  chr5:1922987-1923074
  Hypo

SEQ ID NO: 124183 - DNA, 1233 bp, Homo sapiens
  chr5:1930795-1932028
  Hyper
ctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcaggtgaggaatggggtctgcttcgtttggaatgtgcctttgccgggtcctgcctgacctccaccttccagccgggacgcgcgagcttttccgtttggctgagtcaaaaagggatcgcgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctgggaaaccaggtgctcgccaggtgtccctc

SEQ ID NO: 124184 - DNA, 205 bp, Homo sapiens; identical to SEQ ID NO: 93710
  chr5:1949464-1949669
  Hypo

SEQ ID NO: 124185 - DNA, 492 bp, Homo sapiens; identical to SEQ ID NO: 93711
  chr5:1950766-1951258
  Hypo

SEQ ID NO: 124186 - DNA, 199 bp, Homo sapiens; identical to SEQ ID NO: 93712
  chr5:1951511-1951710
  Hypo

SEQ ID NO: 124187 - DNA, 312 bp, Homo sapiens
  chr5:1952624-1952936
  Hyper
tggggcctggcaggccggggtccgcggagtgaggagtttatcaggatgacataaagaggtgcagtggatgaccgctgtatgaggttaagcacaggcaggcggtgcagatcccaggagtttgtttaggagaagcggagccttgcctctggtgcttcctgtgaactacaatctgaatgacaatccggcagcccagagcctcccctggattccagggaagccgggaaaagctgcttcctgcgggactcatctcagggttccctggaaggagacaaagagcagacctgaaatttagtcagccgcttaaaacacttg

SEQ ID NO: 124188 - DNA, 68 bp, Homo sapiens; identical to SEQ ID NO: 93715
  chr5:1959631-1959699
  Hypo

SEQ ID NO: 124189 - DNA, 152 bp, Homo sapiens; identical to SEQ ID NO: 93716
  chr5:1983598-1983750
  Hypo

SEQ ID NO: 124190 - DNA, 62 bp, Homo sapiens; identical to SEQ ID NO: 93717
  chr5:2007735-2007797
  Hypo

SEQ ID NO: 124191 - DNA, 188 bp, Homo sapiens; identical to SEQ ID NO: 93718
  chr5:2024999-2025187
  Hypo

SEQ ID NO: 124192 - DNA, 565 bp, Homo sapiens
  chr5:2038424-2038989
  Hyper
tgcactgttgaaaagcggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagccaacaggtggcacaaacgcatttgacttgggcatcgatcgccgcgcccgcccggggccgcacctccgccgccagcgtccctccagcccggccccgatgccgcgcaggcgcagtgctcttctctccgcgggccgggccgggtcagggtcaggatctgacccgagtctgggtcaagccatggcgggcggcaggcagcggacggcggcgcccaggcagtgcgccctctgctggccactcgtgtacacgctggctccagccagtgctgcactcctggcagacaggggcc

SEQ ID NO: 124193 - DNA, 35 bp, Homo sapiens; identical to SEQ ID NO: 40447
  chr5:2112239-2112274
  Hypo

SEQ ID NO: 124194 - DNA, 504 bp, Homo sapiens; identical to SEQ ID NO: 93723
  chr5:2136910-2137414
  Hypo

SEQ ID NO: 124195 - DNA, 30 bp, Homo sapiens; identical to SEQ ID NO: 93724
  chr5:2155918-2155948
  Hypo

SEQ ID NO: 124196 - DNA, 331 bp, Homo sapiens; identical to SEQ ID NO: 93725
  chr5:2180344-2180675
  Hypo

SEQ ID NO: 124197 - DNA, 230 bp, Homo sapiens; identical to SEQ ID NO: 93726
  chr5:2199933-2200163
  Hypo

SEQ ID NO: 124198 - DNA, 180 bp, Homo sapiens; identical to SEQ ID NO: 93727
  chr5:2250142-2250322
  Hypo

SEQ ID NO: 124199 - DNA, 82 bp, Homo sapiens; identical to SEQ ID NO: 93728
  chr5:2261231-2261313
  Hypo

SEQ ID NO: 124200 - DNA, 150 bp, Homo sapiens; identical to SEQ ID NO: 93729
  chr5:2261610-2261760
  Hypo

SEQ ID NO: 124201 - DNA, 32 bp, Homo sapiens; identical to SEQ ID NO: 93730
  chr5:2268219-2268251
  Hypo

SEQ ID NO: 124202 - DNA, 30 bp, Homo sapiens; identical to SEQ ID NO: 93733
  chr5:2301052-2301082
  Hypo

SEQ ID NO: 124203 - DNA, 30 bp, Homo sapiens; identical to SEQ ID NO: 40452
  chr5:2324383-2324413
  Hypo

SEQ ID NO: 124204 - DNA, 39 bp, Homo sapiens; identical to SEQ ID NO: 93736
  chr5:2367627-2367666
  Hypo

SEQ ID NO: 124205 - DNA, 30 bp, Homo sapiens; identical to SEQ ID NO: 93737
  chr5:2368819-2368849
  Hypo

SEQ ID NO: 124206 - DNA, 68 bp, Homo sapiens; identical to SEQ ID NO: 14739
  chr5:2369614-2369682
  Hypo

SEQ ID NO: 124207 - DNA, 164 bp, Homo sapiens; identical to SEQ ID NO: 40454
  chr5:2374826-2374990
  Hypo

SEQ ID NO: 124208 - DNA, 195 bp, Homo sapiens; identical to SEQ ID NO: 93740
  chr5:2376679-2376874
  Hypo

SEQ ID NO: 124209 - DNA, 30 bp, Homo sapiens; identical to SEQ ID NO: 93741
  chr5:2412208-2412238
  Hypo

SEQ ID NO: 124210 - DNA, 166 bp, Homo sapiens; identical to SEQ ID NO: 93743
  chr5:2493697-2493863
  Hypo

SEQ ID NO: 124211 - DNA, 190 bp, Homo sapiens; identical to SEQ ID NO: 93744
  chr5:2523561-2523751
  Hypo

SEQ ID NO: 124212 - DNA, 162 bp, Homo sapiens; identical to SEQ ID NO: 40457
  chr5:2541481-2541643
  Hypo

SEQ ID NO: 124213 - DNA, 30 bp, Homo sapiens; identical to SEQ ID NO: 40458
  chr5:2547162-2547192
  Hypo

SEQ ID NO: 124214 - DNA, 30 bp, Homo sapiens; identical to SEQ ID NO: 93747
  chr5:2562122-2562152
  Hypo

SEQ ID NO: 124215 - DNA, 42 bp, Homo sapiens; identical to SEQ ID NO: 93750
  chr5:2642066-2642108
  Hypo

SEQ ID NO: 124216 - DNA, 2245 bp, Homo sapiens
  chr5:2738816-2741061
  Hyper
ctcaccacccccagccgcacgcttgggcctccctcctcctgtgcctccgggaccgtctccccacctgcgggaggccaggtgtgtggctccagagaccctccacctgaactacccgctcccagagccccagtcagggccgccagaggtcgcggagggtgaagccaatgggcctggacgccgaggccggggagaggaaggagcgaggtaatggctgtggctggagaccctcttctgactccccaggctgccgggtaggcctactgtgggatgggactcaggcgaccagacgtgctctccgtcgcctccatcccggccgctgactccgctgtgtccccttggatccatcaccacctccaggcagccctccagcgggttctggtggcgccgagagcttcgaggggactcaacgcgctttgtagggcctgtgaaatccggcttgtcgcataagctccctgaagaagagaacaaacttcccagaccaggggcccgcggggagcggtgcagacaccgcggcaacccaccccgagcccgccggccctcgctccgtgcgcccaaggggcgtcccccgaggtgtcgcctgcaaggcagccgcgtacgtcgttctcagtgcgggtcctgggggcggcggtgccgggggtacggcctggggtcccgtcggtgtccactgcccgcctgggcgctggggccgcagatcggggctacacggctcgcgccgaccgaacgctgccgccagagcggtggaaaagcgctgggcaggccggcctggggctttcgagctctgccgccgagcgcagcagaaatacggtgtgcaggcaggacccgaaacaggagagaccggggggaccggggaggagaggaaggctggctgtggcaggaacccgggcgctcggcacctcccctggtcccgggggccctgaacccccgccgccgtcgccgccggaccccgcgatcgtcctgaacccgggccgggcgctttcggtttcccggcgctctgcggcgctgctttgttcaccctgcgcgcgcggttcccagagtccagagctgcgggcctgaggctgagggccagggagcgaggcgagcacccggggccagccacggaggagtcccgaccaccacgggagcagggggactgggaggcaagaggtcgggggaggccggggtcagggcgggaggaacccgatgggtcccgctgcggcttcaggcgcggggtatagggtaggaccaggaaggggactgaagcccgggaccagagctgggggtgccaggagcggggcctccagtgggagctcgggggtcctcgcgggttcttctgggtcggttggtggctacccatccccagaagcctggctgcattcccctataaggaggcttcggagggcccgactgggtttcccctccagggcaccgggtcgcaaaagcggcgtcgaaaactcatgaacaggcggccgggtctggggccgccggggcagtcgtggcgtgcgggggcgggggtcctgcccatcaggctgacttcagggtctcggtctgcggcctccctggccgtcgctgcctccttttccaggtgcgcctcggcccagggctcccagccaccaccttggggccgcagaaggcgagcggtcacaccggggctgaggtcaggagccggctcaccccctctcctgcgactgttccctgacctgcgactgttcggttctcccgactggccttggtcgttgccttttagggtctcggtgtgaccaactaagcagacactcagcggcagcgccgcgcttggggagactgcagggcagaaatgggcctagaggtgaaggagcccttcccaaatcggacagtcccggggctggagagccgggagcaacccagttccctgaagaaatgattgcagctgctcaggcaaaacacgtaggcctggaaccaaccctgggtgggcgtttaagggcttgagccagcttctgcccctcaagactccccagggagcacgcgcctgcggggaaggacgtgggccgggtggaaggtggcccggaaccccgggaagaacgcgggcagggcaccaggcaggcagccgggccagcgcctccagctcccgcaccttcggcccagggtctccagcactgggaaggcgacagcggcgacagtgcaccgtcccccttgcacgcactgaggagcctgtcttggagctgagacctcctcgccccctccgagcttactgagcacccggccggcagccccccgactccccaggatg

SEQ ID NO: 124217 - DNA, 239 bp, Homo sapiens
  chr5:2743505-2743744
  Hyper
gcgccccggtgctctcggcagcccccggcccccggggcccacctgagattaaagcgcgaattccgataaatcagctctaaggaaaccctgggccgcggagagcagaagggctgtcgcggatccaccacgcgggcgccgggccgcggagccgggagcgcgcccaggcctgcacccgcagcaaagccaaggccaccgccccaaagcccatctgctcctggtcgccccgttttgccgacgtc

SEQ ID NO: 124218 - DNA, 110 bp, Homo sapiens; identical to SEQ ID NO: 93760
  chr5:2747745-2747855
  Hyper

SEQ ID NO: 124219 - DNA, 1646 bp, Homo sapiens
  chr5:2748083-2749729
  Hyper
ccaacggcagaaaagcggattcaactctgactccttaacaagacaccgaaacacacccaggctcattagggcgacacgctgtaatttgaatttcgtggcaatctgggtttgccgaaactaagacagccacgatagtaatagtcaaaataacagtaaattaagtaaaaataaataataacagggcaagtctaaaaagagggccacaccttctttggcttccatctcgccctccgccctcactctgctaattctgggtcccaggagtggccccctggatcttcttcccggaccctccctcgggtctcccgggcgctccgcctccccggggctggctctccctcccctcccgggcgccgccggccgcgggccgcctacctttcttgggctcgtagccgccgcccggggaccggtagtgggactcgagcgggtgcgcgcccgccttgcccgcgtcgctggccgcctttggcgcggtgtgcagggcctcgccgggggccgcggccgcagagttgtaccgcaggagaccctggccctgcagcgccgcgttcaagttcccgtagtttgtgtagttgccgtagaagggcgacgtgtagtagagggggcggcccagcagcggcgaggcagggtagggcgagcctcctggcggtgccccggttgaggccggcgcggcggccgcgggcagccccggtggcccgcagcccgggcccaggctcggctgcttgaggtccgacgtggcgatctcggccagcgaccacagcttgggcttgctggcggggggcggcgcgcccggagacgtccggctgccctggggcgtcttgcggccaccgcggggcgcggcctcgggcggggggctcagcagcggcgcctccaagccggtaagcggcgacgaggtcacgggcttgggcggcgccaggccccgctcgccctcctcgtcgtcgtcctcgtcgtcctccaggtcgtcatacttgtccttgcactccgagcccgattcgcacagggggtccccggcgcggcacggaagcttctccccgtccgactcggccgagcacgagtgatccgtgagcgagtccacgtgcaggctgatccctgtgggggcgcgggcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtccggcgggcaacgtcctccccgccttagctctgcgccccgcctgggaagaaagcgccccgagaccttgcgccggccgctgcccgctcaccttcgtcctctgccgaggtctccgtgccctcctgcgccttgtcgggactctcgtccttgcttctggtagcgtcgccctcgtcctcgtcctcatcttcgcttttgtttctcggggcccaggtcatcttgttctccttcttgaggcgccggcgcgcgttggcgaaccaggtggagacctgggtgagggtcatcttggtgatgatggctagcatgatcttctcgcccttggtggggt

SEQ ID NO: 124220 - DNA, 114 bp, Homo sapiens; identical to SEQ ID NO: 93765
  chr5:2750008-2750122
  Hyper

SEQ ID NO: 124221 - DNA, 665 bp, Homo sapiens
  chr5:2750703-2751368
  Hyper
tttgaaagcatggtccgctggacagagtaaggccgaaacctgggcgcctcgggccggactccggagccgcagctgaatgctcggctcctgggcctaactcggtgacccccaccgccctgagccccgcgagtgaatgcgaaccgcccggccgtcggctcagaggccgcagtgacgcggaccctcgcgccccacgccaatgcaggcgagcacacagcccgctccgaacgcctccccaggctgcggtgcggaaaccagggacaaacggcgccagaccccggccccggcggagacgcacttcccaggctctcagagaaaatcagccggcgagccgaggggacgcgcggggggcgcgcgggtcccggccgggctcagggacgtccccgcctgccgcgctgccctccccacccggggcccggctcagcctgcggggcggccaaccgagccggcgactcctgagtcgccagccgcgccacattcccggcggcccccgcccgccgaacccgagccccgctccgcctgagccccgtctgggtcccggcgcccaggagtcccgcgtcccgcccgcgcccggttaccatgtaggacgggaagccggcggcggcggcggcggcgtcggccgagtactgcagcgggctcccgaagccggtggccgcctgcgccgtgaa

SEQ ID NO: 124222 - DNA, 1915 bp, Homo sapiens
  chr5:2751657-2753572
  Hyper
gggtactagcctgggcggcccgcgggccggggcggcggcggggtggcggtggcggcggcagcagcgcggagccggtgggcgcagccgcgcgccaggccggcggtcggggtttgggggagtctggagtcgggagtgaggagttgaggaaggagcgctcgagtttccgagggacattggaacgcgcagctgtccatcacgcgctcatctgcatattcgggggcccgcccctcccctgctccgcccgctgcagcctccgggccgcggccgggggaggggcagagagacgggagggaggcgggggagggcggaggcgacggaggcgggcggcgggagggaccggcaggcttttgtggcgcagccgcctctctagcagctccggccccagcccgcggctcgcggacctgcagcccagcccggccgcgctgcgtgccccggcgcgcacccctcccactcccatccactcggagccacgtcccctgcccggctccggccggctcccaccgtccccggccaccgtcttcgcccctgcccggcccccgccccttccagccactaccccgcccccacccccttctccaccctcacggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacactcacggcatcaggctgtctttccccaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcc

SEQ ID NO: 124223 - DNA, 255 bp, Homo sapiens; identical to SEQ ID NO: 93771
  chr5:2754365-2754620
  Hyper

SEQ ID NO: 124224 - DNA, 30 bp, Homo sapiens; identical to SEQ ID NO: 93772
  chr5:2754878-2754908
  Hyper

SEQ ID NO: 124225 - DNA, 2588 bp, Homo sapiens
  chr5:2755142-2757730
  Hyper
ccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggtcgggagcccctcgtggccaggcgtccgcgcggctcaagaccgaggtccgccacgctgggccgctcgtgggcggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagataggactcctcgctcgcaagaaacactggagaaaagaaaataattcctcgagtgtttttacaattattttaatccaaccagcgaggctctaaagagcgtttgtcttgaggccgtgttgaataccctttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggttgggttttgctttctttgctttttatttttattttttaatatggctgggaatgcagaaattttaaaaatggatacatttgagtgtgttaaaagtaaaaacttctcttggacaaaacataaactgctaaccgcaacgggggagaagatat

SEQ ID NO: 124226 - DNA, 39 bp, Homo sapiens; identical to SEQ ID NO: 93775
  chr5:2865625-2865664
  Hypo

SEQ ID NO: 124227 - DNA, 30 bp, Homo sapiens; identical to SEQ ID NO: 93776
  chr5:2889717-2889747
  Hypo

SEQ ID NO: 124228 - DNA, 196 bp, Homo sapiens; identical to SEQ ID NO: 93777
  chr5:2890721-2890917
  Hypo

SEQ ID NO: 124229 - DNA, 100 bp, Homo sapiens; identical to SEQ ID NO: 93779
  chr5:3000087-3000187
  Hypo

SEQ ID NO: 124230 - DNA, 167 bp, Homo sapiens; identical to SEQ ID NO: 93780
  chr5:3027341-3027508
  Hypo

SEQ ID NO: 124231 - DNA, 63 bp, Homo sapiens; identical to SEQ ID NO: 93781
  chr5:3028232-3028295
  Hypo

SEQ ID NO: 124232 - DNA, 322 bp, Homo sapiens; identical to SEQ ID NO: 93782
  chr5:3031752-3032074
  Hypo

SEQ ID NO: 124233 - DNA, 37 bp, Homo sapiens; identical to SEQ ID NO: 93783
  chr5:3051179-3051216
  Hypo

SEQ ID NO: 124234 - DNA, 41 bp, Homo sapiens; identical to SEQ ID NO: 93785
  chr5:3078657-3078698
  Hypo

SEQ ID NO: 124235 - DNA, 36 bp, Homo sapiens; identical to SEQ ID NO: 93789
  chr5:3114736-3114772
  Hypo

SEQ ID NO: 124236 - DNA, 112 bp, Homo sapiens; identical to SEQ ID NO: 93793
  chr5:3122092-3122204
  Hyper

SEQ ID NO: 124237 - DNA, 40 bp, Homo sapiens; identical to SEQ ID NO: 93794
  chr5:3142468-3142508
  Hypo

SEQ ID NO: 124238 - DNA, 301 bp, Homo sapiens
  chr5:3197714-3198015
  Hyper
ttgcacatccgttatcgtggctgcttgatttccgtagaaatcaatctaaagaacccgcggtcctgtggcgtgatttcctgggactgacttcctggagaggctactgcgggatgtgaggggctggcaggagcggccctccctggccttggccattgtctttccggagaggcattctgcccccgctcccgtcacttgcgatgagtcccctttcccagagcggcgcactctccaggccagcagcacaaaagattgctttgctcaatcttgagcttgggtgcgcccggcacgagctccgtgacga

SEQ ID NO: 124239 - DNA, 134 bp, Homo sapiens; identical to SEQ ID NO: 40464
  chr5:3221047-3221181
  Hypo

SEQ ID NO: 124240 - DNA, 30 bp, Homo sapiens; identical to SEQ ID NO: 40465
  chr5:3269777-3269807
  Hypo

SEQ ID NO: 124241 - DNA, 191 bp, Homo sapiens; identical to SEQ ID NO: 93832
  chr5:3273116-3273307
  Hypo

SEQ ID NO: 124242 - DNA, 17 bp, Homo sapiens
  chr5:3283330-3283347
  Hypo
ggcgcacacacatgaac

SEQ ID NO: 124243 - DNA, 580 bp, Homo sapiens; identical to SEQ ID NO: 93842
  chr5:3324753-3325333
  Hypo

SEQ ID NO: 124244 - DNA, 35 bp, Homo sapiens; identical to SEQ ID NO: 93846
  chr5:3339624-3339659
  Hypo

SEQ ID NO: 124245 - DNA, 30 bp, Homo sapiens; identical to SEQ ID NO: 40467
  chr5:3422389-3422419
  Hypo

SEQ ID NO: 124246 - DNA, 30 bp, Homo sapiens; identical to SEQ ID NO: 93858
  chr5:3452425-3452455
  Hypo

SEQ ID NO: 124247 - DNA, 263 bp, Homo sapiens; identical to SEQ ID NO: 93859
  chr5:3454166-3454429
  Hypo

SEQ ID NO: 124248 - DNA, 184 bp, Homo sapiens; identical to SEQ ID NO: 93865
  chr5:3487829-3488013
  Hypo

SEQ ID NO: 124249 - DNA, 158 bp, Homo sapiens; identical to SEQ ID NO: 93867
  chr5:3535627-3535785
  Hypo

SEQ ID NO: 124250 - DNA, 30 bp, Homo sapiens; identical to SEQ ID NO: 93868
  chr5:3536520-3536550
  Hypo

SEQ ID NO: 124251 - DNA, 572 bp, Homo sapiens
  chr5:3590331-3590903
  Hyper
gtcatttcaagaaggcggagatgcaaacacaacacggagaggggatgtctcctgtctagagattccagggcagtttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcccggcctcctctaatgacattaggagccgcagccacgacggcgctcacgggggcgcagaagtcccgctggctttgatccgcgcctctccgctgccgagagctgacagtcggctgcgcagcggccccgctttcatttgtcagacacgcgtttgccggtgtacccgcgcaggcagctacacctgtactgagagaatttacatcgccttgcttcgggatggcattgatttgggacgggtgaaatacaaa

SEQ ID NO: 124252 - DNA, 347 bp, Homo sapiens; identical to SEQ ID NO: 93872
  chr5:3591111-3591458
  Hyper

SEQ ID NO: 124253 - DNA, 180 bp, Homo sapiens; identical to SEQ ID NO: 93873
  chr5:3591857-3592037
  Hyper

SEQ ID NO: 124254 - DNA, 380 bp, Homo sapiens
  chr5:3592501-3592881
  Hyper
gtcaccccccattgccgagcttcgcggggtcttgccagccttctgggccacgtgccttgggtccccggagcactggggcccaagggcttccggactggatccccggcgctaagcaggaggagctccgattccgctgcgcagcgacccctagacctggttttgtcaggctcctcgtctttgtctctggcacagtgaccagggggcagccaccgggtgcggccagctccgccaggagcaacttccggagcagcggcagggcctgcctcagccaccccctttggaggcaggaaaagtggctgaggggccaacaaagtggctctctcctgcctcagaggtccagcgcctcacagctggggcgtcggtttcgaaggccaagcaga

SEQ ID NO: 124255 - DNA, 2963 bp, Homo sapiens
  chr5:3594047-3597010
  Hyper
gaggaggttgaagatcggaaatctgtcttagggttagaaggtgtctggtggtaggctggggaacaggaaaaagctgcagttaggggcttcccggatttgtgtcaccaagaatccactccccaccaaccctcggcgtccccacaaacccagcccggaatctatgtaaaagcaggaaaggaaccctggaggttgtaggcggatcctggagtgtggaggggcgaattgagcgcgggaagcagcatgactagcaagacaatctgactcagagcagggaaaaatcaagcccgatgtcggagctggttattagtaattactaccatcacgggcattattgttgctaattataggcgatgtctcagtgtctgtcctcaggcccggaaaaccggagcccctcctgatgctgctgaagtccctgggcctcgaggctccgtgaagagagggaagcgaggcagggggtgaagggaccgcctggccggtgtccaggatacgggtggctcaaaccaccagcagaacagcatgccgactctggcccgatggccgccttcatcccgtagccccaacccggcctaaagccgagaagacgccagagtgcgctgctgaaattcccgcggagtccggtgtgctggagagccgcagcggggtgaactcccggccccgtctctgcgtaggaggtggttcgcaaagtggccccgggagccgggactggtacccggttccccacggcaccgtccggagctctccagccacgaggcgcagaagtggcctgccagcgccttcccaggctcagggaggcgaggaggcccgtgcacttggcatcttctcccgggagccgcacggccagggccgcggcgaaacggagcccatctcaagtgcgccgcgcctggccgcgtcctgtagcccgacgaggctgaggatggagaggggagacgcagggagaagagggacgcgggacttggacccaagaggccgctccgttgccggtctggcggcggcgccgactcgggttcgcgcgttccacacaagtttcctgtctgcctctgcacacctggtggacaaaccgggcgtccaggccacaccgtcttcccccttcgcgggggcgcgggggatgtttccctccggctgccagggggctttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggccggtcattggcagacgatcggttactacccagtaggggcccacgggaacccgcatctggagtcgggggtgtcacgccacgccggttcagtggctcgcggagagcgtccgggtgcacttctgccaaagatgtcccctggaggccccggccgcgcgggactcgggggagaggccgctcccccctcgctgtcaccagcgtccaggccgccggccccttccccgctgcccaaacagtagaaaagcaggcgccaagttgtttttgttaaaaaggggacacacctcggccgcgaaactgcaaacccggtgtcagacagctgtaaacccgtgtcgacaggttgtcagacagctgcgggggctggtcgggaaggagcccacggcctccgggcccacaccccgccgccccgacgcgcgcgcccaccgcgagagtagctggccgggccggcacggggcaccacgtgctcgcgggaggggcgggagcggccggcgagggcgggcgggaggcagggagggggcgggaggggagccaggggcggggcctgcgctcaaggggatgccaatcaaagcatcaacttcaaattgtgtctgaaagccccgccgccgagcggagggcggccgccgcagtcggcgcgcgattgcggatccgggcgcagccgggagccgggcgcctgcgagcaccgggcagaggagccgcgaccggcctccatctcccggcccgcccgagcgcgcccggccggccgcccgctcctccctagacccctcgcggcgccccctgcaaccccctccggccggcctccgcctccctccccgcgcctttaatactcgcccgctgcggcggtcgccgagtccgcggacatgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatggtgagtgcgcccggcctcccccgcttctcctctgtctcacccgcgccagggcaagggtggcgggtcgcccgggagggagagactacgggtggacctggtccggaagaggaactagaaaggtccgggggcaggttcccggtggccgaggccgcggcccccggggacgcaagagggctgggaggccgggcgggtgacggctgggccatctcggcctgggaaagcggaaggcccgggccagggagcgggtagcgagtgaattcagagaggccgcagaagcaggcccgtggagcggtgcccgcgctggaggtcgggggcaaactcgcctggctcggccagggcgcccgggcaggcccacggggttcctgcaggtcggcccggcgtagcgtagcaggacttcccttcctggccgcgggttccactcgcgcggcctctttagttttcgaaccgagtctggaaaacttggttttctccctctttagcagctccgagatagttgtatccgagtttgccagaca

SEQ ID NO: 124256 - DNA, 510 bp, Homo sapiens; identical to SEQ ID NO: 93881
  chr5:3597357-3597867
  Hyper

SEQ ID NO: 124257 - DNA, 30 bp, Homo sapiens; identical to SEQ ID NO: 93883
  chr5:3598863-3598893
  Hyper

SEQ ID NO: 124258 - DNA, 2007 bp, Homo sapiens
  chr5:3599364-3601371
  Hyper
ccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccaggtacagctccaggccgcgtccacctgtcccctagctgggaatgcagaggcctggctaggtgtggtagcgtggggtgcagcatgagccgggagggtaccaggcagtggccgctgagccctggggctgcgcttaatccctgcttcaatttagaaagccagacaaggccctagggctctcccaagagagctttgccctaccggcgggcctgctacggggtggtggtggggtgaggggtgacgtttttcggcgaatctgcctgggcagccggcagaagttggtgggaaggaggcctgggacctctcccgcccgtctctccgtcctaactctgcctcttccgatctctcgcagagagagacctcgtccccaggccagattcgccggcacagcagttaaagtcgcccttccagccggtacgcgacaagtgagtgctgtttgcttttgctatgggagaaggcggtggggaggggggaggaggagtggtcgggacccgggcggagctggctgggtggcggtgggggtcgcgcagtcctagttgaaggagcgctccccgccagccctgggcgccgggcgagccgaggagactggagtttctccccagccgggagccgcgctggctgtcgaccccgcccccagggctccgctactggaaccggcgtcgcccggcgctgcgtcccccactcacagtgcccctgtcttcttgtctcgctgtgtttcccatgcagctctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctg

SEQ ID NO: 124259 - DNA, 49 bp, Homo sapiens
  chr5:3602466-3602515
  Hyper
cagcatcagtgggttcggagcgggacgcgcgccacgcgccgcagcaggc

SEQ ID NO: 124260 - DNA, 653 bp, Homo sapiens; identical to SEQ ID NO: 93890
  chr5:3602804-3603457
  Hyper

SEQ ID NO: 124261 - DNA, 880 bp, Homo sapiens
  chr5:3606268-3607148
  Hyper
ttaataagtttctcacgaagaaggagtctgccttaggcccacggaagtcaccacgtggcctgggactgaggaggcttcaggagcgacctaaaatgttaggattgctctaaatgaggaggcagagaaagggcggccttgaacccgggagggagcaagggatggagctgcgccctgggtggcaagacatggcaagccaggcagctgggacctagagaaggctcggccgcgccgcaggatcccaggctgtgggcctgaatggtgaccacgcggagtcggagtcagctcgcgtccgcgccgtcccagctccccgcctgaacccggcgcccctccgcgaggaaaggccggccctggccctttctgggcagtgaggggggtcaggccgacccggggaagaggccgagcagtcagcgcccctccttcccctcgggcggggcataagtggccgccctctccgcggctgctgttgggcttctgaagacgcagcgggtgtctctgatcccctaatccatttatccagagtcccgagcgcaatggctggtgcggggacacaacggcaggaggtggcgggggtggagggagaccgggcactcagctagcgccaccctcctcccgccccacccgagacgctgagccacgacccaccctccacgggtcccacgccctcaggcagaacgcaatggtgggaatgacgccaaggtcggtgaaatcttccaaattgaagggcttttattttaaattccgattcccctttgaaacagccctttcgatgagggaagaagccagctcggtttctgcgtgcgtgtttatgatctacctgtgagcgcggcgctctggaaggtcacccaggctgcggacgccctgatagcggggtgacagcctg

SEQ ID NO: 124262 - DNA, 34 bp, Homo sapiens; identical to SEQ ID NO: 93894
  chr5:3613874-3613908
  Hypo

SEQ ID NO: 124263 - DNA, 30 bp, Homo sapiens; identical to SEQ ID NO: 93895
  chr5:3623145-3623175
  Hypo

SEQ ID NO: 124264 - DNA, 34 bp, Homo sapiens; identical to SEQ ID NO: 93896
  chr5:3639390-3639424
  Hypo

SEQ ID NO: 124265 - DNA, 176 bp, Homo sapiens; identical to SEQ ID NO: 14743
  chr5:3674048-3674224
  Hypo

SEQ ID NO: 124266 - DNA, 178 bp, Homo sapiens; identical to SEQ ID NO: 93906
  chr5:3724955-3725133
  Hypo

SEQ ID NO: 124267 - DNA, 314 bp, Homo sapiens; identical to SEQ ID NO: 93909
  chr5:3740703-3741017
  Hypo

SEQ ID NO: 124268 - DNA, 121 bp, Homo sapiens; identical to SEQ ID NO: 93911
  chr5:3761119-3761240
  Hypo

SEQ ID NO: 124269 - DNA, 56 bp, Homo sapiens; identical to SEQ ID NO: 93912
  chr5:3761567-3761623
  Hypo

SEQ ID NO: 124270 - DNA, 69 bp, Homo sapiens; identical to SEQ ID NO: 93913
  chr5:3775375-3775444
  Hypo

SEQ ID NO: 124271 - DNA, 165 bp, Homo sapiens; identical to SEQ ID NO: 14745
  chr5:3806428-3806593
  Hypo

SEQ ID NO: 124272 - DNA, 149 bp, Homo sapiens; identical to SEQ ID NO: 40475
  chr5:3856433-3856582
  Hypo

SEQ ID NO: 124273 - DNA, 187 bp, Homo sapiens; identical to SEQ ID NO: 93933
  chr5:3859680-3859867
  Hypo

SEQ ID NO: 124274 - DNA, 194 bp, Homo sapiens; identical to SEQ ID NO: 93948
  chr5:4083866-4084060
  Hypo

SEQ ID NO: 124275 - DNA, 217 bp, Homo sapiens; identical to SEQ ID NO: 40479
  chr5:4144299-4144516
  Hypo

SEQ ID NO: 124276 - DNA, 30 bp, Homo sapiens; identical to SEQ ID NO: 93953
  chr5:4145036-4145066
  Hypo

SEQ ID NO: 124277 - DNA, 34 bp, Homo sapiens; identical to SEQ ID NO: 40480
  chr5:4278472-4278506
  Hypo

SEQ ID NO: 124278 - DNA, 31 bp, Homo sapiens; identical to SEQ ID NO: 40481
  chr5:4279105-4279136
  Hypo

SEQ ID NO: 124279 - DNA, 215 bp, Homo sapiens; identical to SEQ ID NO: 94015
  chr5:4581114-4581329
  Hypo

SEQ ID NO: 124280 - DNA, 35 bp, Homo sapiens; identical to SEQ ID NO: 40483
  chr5:4629575-4629610
  Hypo

SEQ ID NO: 124281 - DNA, 226 bp, Homo sapiens; identical to SEQ ID NO: 94017
  chr5:4629982-4630208
  Hypo

SEQ ID NO: 124282 - DNA, 30 bp, Homo sapiens; identical to SEQ ID NO: 40484
  chr5:4630470-4630500
  Hypo

SEQ ID NO: 124283 - DNA, 36 bp, Homo sapiens; identical to SEQ ID NO: 94026
  chr5:4866865-4866901
  Hypo

SEQ ID NO: 124284 - DNA, 30 bp, Homo sapiens; identical to SEQ ID NO: 40486
  chr5:4867541-4867571
  Hypo

SEQ ID NO: 124285 - DNA, 30 bp, Homo sapiens; identical to SEQ ID NO: 94029
  chr5:4879422-4879452
  Hypo

SEQ ID NO: 124286 - DNA, 30 bp, Homo sapiens; identical to SEQ ID NO: 94044
  chr5:5049628-5049658
  Hypo

SEQ ID NO: 124287 - DNA, 1374 bp, Homo sapiens
  chr5:5139610-5140984
  Hyper
gacccccgtggcggccgagacccaggcccatccgcagccctgagacctccctagggattgcacccagcagccagtcaccggcctccgcggcctggccagttgagggtggccgtgaccgcggggccaggagcgccgccacatctcggggcaaatggcgcgggggaagagtttcctcctcagcctccccgtctccgatcgctccgcaaactccagagcgaggcacgcgcctttaaaggcaggtccgcggctctcccacgtcctggcgcccggttttccgcacccagtgtccccacagctgtgcccgggcacagaggcgcggccagaccgcactccgcgggctgcaggtgtcccggcctctggcggcgccggtgcggcccggaggtgggagcccgcggagccactgcagtagctggagtcccgccgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgggcagctccatcttcccgcgtcctcctcctctggcgctgcccgctgtctcccgccttccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggtgagtcccgggcgctcccaccagcgcggaaaccgcgggtccggacagctggaggcgagtcccccgcggctcctctcccgcggaccccgccgtctcaccgcgatgtcgccgctgttttccgcaggcacctgcgtgcgccatgggacccgcagcggcagcgcctgggagcccgagcgtcccgcgtcctcctccacccgcggagcggccgggctggatggaaaagggcggtaagtccgtgaggtgggggcttctaatccttgccatttagcagctcgtaatctccgtgccgctggtttattaggtgctgtgaatgttcacgactctgtggaacc

SEQ ID NO: 124288 - DNA, 178 bp, Homo sapiens; identical to SEQ ID NO: 40487
  chr5:5296474-5296652
  Hypo

SEQ ID NO: 124289 - DNA, 30 bp, Homo sapiens; identical to SEQ ID NO: 40488
  chr5:5303702-5303732
  Hypo

SEQ ID NO: 124290 - DNA, 30 bp, Homo sapiens; identical to SEQ ID NO: 94077
  chr5:5320109-5320139
  Hypo

SEQ ID NO: 124291 - DNA, 185 bp, Homo sapiens; identical to SEQ ID NO: 94103
  chr5:5571260-5571445
  Hypo

SEQ ID NO: 124292 - DNA, 199 bp, Homo sapiens; identical to SEQ ID NO: 94104
  chr5:5577412-5577611
  Hypo

SEQ ID NO: 124293 - DNA, 30 bp, Homo sapiens; identical to SEQ ID NO: 40491
  chr5:5652506-5652536
  Hypo

SEQ ID NO: 124294 - DNA, 211 bp, Homo sapiens; identical to SEQ ID NO: 40492
  chr5:5719870-5720081
  Hypo

SEQ ID NO: 124295 - DNA, 30 bp, Homo sapiens; identical to SEQ ID NO: 94117
  chr5:5880192-5880222
  Hypo

SEQ ID NO: 124296 - DNA, 46 bp, Homo sapiens; identical to SEQ ID NO: 94118
  chr5:5886643-5886689
  Hypo

SEQ ID NO: 124297 - DNA, 109 bp, Homo sapiens
  chr5:5887137-5887246
  Hyper
acagacccaggcatccggccgggtccccgcagcccgtgtgcccgctcccgcctccgccagcagagggagcgcgcggccccgcccaggcacctggcggtgacacctgcca

SEQ ID NO: 124298 - DNA, 173 bp, Homo sapiens; identical to SEQ ID NO: 94121
  chr5:5890841-5891014
  Hypo

SEQ ID NO: 124299 - DNA, 88 bp, Homo sapiens; identical to SEQ ID NO: 94123
  chr5:5907706-5907794
  Hypo

SEQ ID NO: 124300 - DNA, 30 bp, Homo sapiens; identical to SEQ ID NO: 94133
  chr5:6029681-6029711
  Hypo

SEQ ID NO: 124301 - DNA, 30 bp, Homo sapiens; identical to SEQ ID NO: 94134
  chr5:6080787-6080817
  Hypo

SEQ ID NO: 124302 - DNA, 256 bp, Homo sapiens; identical to SEQ ID NO: 94136
  chr5:6219037-6219293
  Hypo

SEQ ID NO: 124303 - DNA, 30 bp, Homo sapiens; identical to SEQ ID NO: 94137
  chr5:6228545-6228575
  Hypo

SEQ ID NO: 124304 - DNA, 30 bp, Homo sapiens; identical to SEQ ID NO: 94138
  chr5:6264312-6264342
  Hypo

SEQ ID NO: 124305 - DNA, 880 bp, Homo sapiens; identical to SEQ ID NO: 94150
  chr5:6448738-6449618
  Hyper

SEQ ID NO: 124306 - DNA, 30 bp, Homo sapiens; identical to SEQ ID NO: 94151
  chr5:6456111-6456141
  Hypo

SEQ ID NO: 124307 - DNA, 30 bp, Homo sapiens; identical to SEQ ID NO: 40494
  chr5:6478603-6478633
  Hypo

SEQ ID NO: 124308 - DNA, 39 bp, Homo sapiens; identical to SEQ ID NO: 94157
  chr5:6522524-6522563
  Hypo

SEQ ID NO: 124309 - DNA, 30 bp, Homo sapiens; identical to SEQ ID NO: 94158
  chr5:6550961-6550991
  Hypo

SEQ ID NO: 124310 - DNA, 30 bp, Homo sapiens; identical to SEQ ID NO: 94159
  chr5:6582801-6582831
  Hypo

SEQ ID NO: 124311 - DNA, 578 bp, Homo sapiens; identical to SEQ ID NO: 94160
  chr5:6583176-6583754
  Hyper

SEQ ID NO: 124312 - DNA, 175 bp, Homo sapiens; identical to SEQ ID NO: 94161
  chr5:6586039-6586214
  Hypo

SEQ ID NO: 124313 - DNA, 321 bp, Homo sapiens; identical to SEQ ID NO: 29452
  chr5:6687127-6687448
  Hyper

SEQ ID NO: 124314 - DNA, 70 bp, Homo sapiens; identical to SEQ ID NO: 94179
  chr5:6867674-6867744
  Hypo

SEQ ID NO: 124315 - DNA, 120 bp, Homo sapiens; identical to SEQ ID NO: 94181
  chr5:6981335-6981455
  Hypo

SEQ ID NO: 124316 - DNA, 1364 bp, Homo sapiens
  chr5:7394900-7396264
  Hyper
gggggctctttgggccggaccacactcgaataggaggaaacttccagaagggtgggttcctttggtgataagcaatgaagccccttcggcccccagggcgaaggccagcggcctccgctcccacgcgtgtcgggaggggacactgtccctggtgacatccgcccccacaacgctcctgccgggtctctagcgcctcctgcgtccaggcccccaaggtgacagggagggagctactcccagggccgacccgcccgctcccgcgcccagccgctctccccggcgcccctttgccgccatccccgctcagcagaggggctcggcgaggaccacgaccagccacggggcagctctgtaaacctgtgatatgacaggcttatacggcacctccaaagtgtgactgaagctgagcgtgcagggcgcaacggacgctgcccccgcgaggccgtggcgggggctcccagtgcagtcactgccgcttcacttccacatggtgccggtctccagttaggtcccctggcgtttccgcgccctgccgccctcgcagggagccccggccctctcaagagggtggagaggatgggggagccctcaaccctgctacgctgaggggaagaagggctggacggcaaaccggtgcccaccgcggggaggcgggaagggtgggaaatcctctccagctccccaaaagagtgaaaaggagggagaccccgctgtcctctgacccgcgtactaaaggagggaccccccgggtcctctgaccccggctgcgctctgtgactgtgggggagggtgggagcaggccccgcagcccactaaggggtggaggaaacaggagggtggcagcgtccctgcccgctgaccttgaggtagtggagaggagctgaggagccccgcagtgctccgagccaggtggggcggggggagtggtgggggtaggactccctccctccaccccttaggctgtgttctcacttcgtagcggggagggccgtccctcccaccccacccacgctgcactcgggatagggcagaggaggtggacgacctggtggctgagtgtgggaggccggcgggcgaggacgaccccgggccggggcgcagcgggagcccctcagttcgccactccccccaccgtacagcccccgccgtccccagcctgcagccgggccgtcgggtgggggccgacaccgcccctgcacggaggccggctgcgcgcggggcggggagcggcgggcggagggccccgtggaacccgccccctcccgcgcggtggcggtggcggcggcggcgccgggagctgcccccgaggccgccgcccggcccccgcccgcgcgtcagcgcgcccagcccggggcgccgagctc

SEQ ID NO: 124317 - DNA, 562 bp, Homo sapiens
  chr5:7396473-7397035
  Hyper
gcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggcagcccctcggcccgcggctccctgcttctcctgctggcccgcggcccggtggactctggcaagggctgcgggcgggagaaaagtttcctgggaaggctcttcccaaaataaagttcccgaggtgttcaccaggtggacgggcagggcgtgtgctttttgcatctttgcgcacccgctggcaaactctgcgctttccgccgggcaccgctgcccgcagcgctggaataggtcttccccgactcagccctgggcttcctgggcgagtcgctgtctcctgcccggttccactggcat

SEQ ID NO: 124318 - DNA, 30 bp, Homo sapiens; identical to SEQ ID NO: 94307
  chr5:7763815-7763845
  Hypo

SEQ ID NO: 124319 - DNA, 336 bp, Homo sapiens
  chr5:7850282-7850618
  Hyper
gctgacactggtagtcgcctgagctgtactctttggggcccaggcgccttggcgggagctcaccctccctgtctccccagctgaccctgccgcgcccccttcatctccgcacgctcccacccggccccctccacaggctgtccagccccgcccctcggaacccacccctggtagtgaagccctgcccccagggtccctgcccgaaggtgcgctcctcctctagggcccctctactctgtgagctctgtccccgatccctagcggtgcagcccctcccagggcccctcctcgttgtgagctcctctctccagtccccggcggcgcatccctgccccc

SEQ ID NO: 124320 - DNA, 377 bp, Homo sapiens; identical to SEQ ID NO: 29462
  chr5:7850922-7851299
  Hyper

SEQ ID NO: 124321 - DNA, 209 bp, Homo sapiens; identical to SEQ ID NO: 94327
  chr5:7954008-7954217
  Hypo

SEQ ID NO: 124322 - DNA, 30 bp, Homo sapiens; identical to SEQ ID NO: 94350
  chr5:8208408-8208438
  Hypo

SEQ ID NO: 124323 - DNA, 23 bp, Homo sapiens
  chr5:9227669-9227692
  Hypo
tttttttttttgagacggagtct

SEQ ID NO: 124324 - DNA, 215 bp, Homo sapiens; identical to SEQ ID NO: 94428
  chr5:9479707-9479922
  Hypo

SEQ ID NO: 124325 - DNA, 435 bp, Homo sapiens; identical to SEQ ID NO: 94433
  chr5:9544685-9545120
  Hyper

SEQ ID NO: 124326 - DNA, 355 bp, Homo sapiens; identical to SEQ ID NO: 94434
  chr5:9545496-9545851
  Hyper

SEQ ID NO: 124327 - DNA, 124 bp, Homo sapiens; identical to SEQ ID NO: 29466
  chr5:9546564-9546688
  Hyper

SEQ ID NO: 124328 - DNA, 84 bp, Homo sapiens; identical to SEQ ID NO: 92706
  chr5:10248589-10248673
  Hypo

SEQ ID NO: 124329 - DNA, 84 bp, Homo sapiens; identical to SEQ ID NO: 92707
  chr5:10248733-10248817
  Hypo

SEQ ID NO: 124330 - DNA, 16 bp, Homo sapiens
  chr5:10252583-10252599
  Hypo
gggcgcggtggctcac

SEQ ID NO: 124331 - DNA, 16 bp, Homo sapiens
  chr5:10252719-10252735
  Hypo
ccgtctcaaaaaaaaa

SEQ ID NO: 124332 - DNA, 299 bp, Homo sapiens; identical to SEQ ID NO: 92710
  chr5:10267147-10267446
  Hypo

SEQ ID NO: 124333 - DNA, 30 bp, Homo sapiens; identical to SEQ ID NO: 40498
  chr5:10269033-10269063
  Hypo

SEQ ID NO: 124334 - DNA, 398 bp, Homo sapiens; identical to SEQ ID NO: 92713
  chr5:10307528-10307926
  Hyper

SEQ ID NO: 124335 - DNA, 709 bp, Homo sapiens; identical to SEQ ID NO: 92714
  chr5:10333423-10334132
  Hyper

SEQ ID NO: 124336 - DNA, 212 bp, Homo sapiens
  chr5:10442313-10442525
  Hyper
agatccacattcccccggagctgccggacatcctgaagcaattcaccaaggctgccatccgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtat

SEQ ID NO: 124337 - DNA, 39 bp, Homo sapiens; identical to SEQ ID NO: 92722
  chr5:10464558-10464597
  Hypo

SEQ ID NO: 124338 - DNA, 30 bp, Homo sapiens; identical to SEQ ID NO: 92723
  chr5:10538891-10538921
  Hypo

SEQ ID NO: 124339 - DNA, 84 bp, Homo sapiens; identical to SEQ ID NO: 92724
  chr5:10563513-10563597
  Hyper

SEQ ID NO: 124340 - DNA, 1273 bp, Homo sapiens
  chr5:10564471-10565744
  Hyper
cggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaa

SEQ ID NO: 124341 - DNA, 129 bp, Homo sapiens; identical to SEQ ID NO: 92729
  chr5:10618114-10618243
  Hypo

SEQ ID NO: 124342 - DNA, 195 bp, Homo sapiens; identical to SEQ ID NO: 92730
  chr5:10630367-10630562
  Hypo

SEQ ID NO: 124343 - DNA, 115 bp, Homo sapiens; identical to SEQ ID NO: 92731
  chr5:10652320-10652435
  Hypo

SEQ ID NO: 124344 - DNA, 193 bp, Homo sapiens; identical to SEQ ID NO: 92732
  chr5:10675371-10675564
  Hypo

SEQ ID NO: 124345 - DNA, 30 bp, Homo sapiens; identical to SEQ ID NO: 40501
  chr5:10864262-10864292
  Hypo

SEQ ID NO: 124346 - DNA, 185 bp, Homo sapiens; identical to SEQ ID NO: 92739
  chr5:10915475-10915660
  Hypo

SEQ ID NO: 124347 - DNA, 33 bp, Homo sapiens; identical to SEQ ID NO: 92741
  chr5:10972987-10973020
  Hypo

SEQ ID NO: 124348 - DNA, 30 bp, Homo sapiens; identical to SEQ ID NO: 92743
  chr5:10986789-10986819
  Hypo

SEQ ID NO: 124349 - DNA, 30 bp, Homo sapiens; identical to SEQ ID NO: 92752
  chr5:11169751-11169781
  Hypo

SEQ ID NO: 124350 - DNA, 719 bp, Homo sapiens
  chr5:11384869-11385588
  Hyper
tgggcgacagggtggcgtacgtgccgatggtggagctcagctggtggatgggcgaggaggagatggtggactgcacggtggggggcgaggtcacgcggatcggggacaggccggccgaggacacgacgatgttgatgggcgagctggtgctgtaggacttggccaggcggctgggcgactgcttgggcgaggagccgcgcggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 124351 - DNA, 30 bp, Homo sapiens; identical to SEQ ID NO: 92780
  chr5:11397823-11397853
  Hypo

SEQ ID NO: 124352 - DNA, 35 bp, Homo sapiens; identical to SEQ ID NO: 92803
  chr5:11644483-11644518
  Hypo

SEQ ID NO: 124353 - DNA, 1624 bp, Homo sapiens
  chr5:11903368-11904992
  Hyper
ggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaagctggaagggacccgggaagggatggaaccccaggttactccgcttccctaattcacgtgcaaggcgctgacagttgactctggtggggcagatgtcagcctgcaacaaaggaccagggtgcgaggggtcctagagtggccaggtgggttgggggagggaggctggcggaacgtgctggtgagcgcaggtagatgctcttgcagatcctgtgattccagagctaaggaggcacgaagtccagcagag

SEQ ID NO: 124354 - DNA, 27 bp, Homo sapiens
  chr5:12351623-12351650
  Hypo
agccaccgcgcccgcccattttcactc

SEQ ID NO: 124355 - DNA, 30 bp, Homo sapiens; identical to SEQ ID NO: 92874
  chr5:12805470-12805500
  Hypo

SEQ ID NO: 124356 - DNA, 227 bp, Homo sapiens; identical to SEQ ID NO: 93039
  chr5:14108613-14108840
  Hyper

SEQ ID NO: 124357 - DNA, 118 bp, Homo sapiens; identical to SEQ ID NO: 93045
  chr5:14142698-14142816
  Hyper

SEQ ID NO: 124358 - DNA, 56 bp, Homo sapiens; identical to SEQ ID NO: 93070
  chr5:14501805-14501861
  Hypo

SEQ ID NO: 124359 - DNA, 30 bp, Homo sapiens; identical to SEQ ID NO: 93099
  chr5:14726922-14726952
  Hypo

SEQ ID NO: 124360 - DNA, 108 bp, Homo sapiens; identical to SEQ ID NO: 93100
  chr5:14731965-14732073
  Hypo

SEQ ID NO: 124361 - DNA, 30 bp, Homo sapiens; identical to SEQ ID NO: 93101
  chr5:14740939-14740969
  Hypo

SEQ ID NO: 124362 - DNA, 32 bp, Homo sapiens; identical to SEQ ID NO: 93102
  chr5:14741558-14741590
  Hypo

SEQ ID NO: 124363 - DNA, 235 bp, Homo sapiens; identical to SEQ ID NO: 93103
  chr5:14756250-14756485
  Hypo

SEQ ID NO: 124364 - DNA, 83 bp, Homo sapiens; identical to SEQ ID NO: 40505
  chr5:14764724-14764807
  Hypo

SEQ ID NO: 124365 - DNA, 33 bp, Homo sapiens; identical to SEQ ID NO: 93105
  chr5:14774559-14774592
  Hypo

SEQ ID NO: 124366 - DNA, 32 bp, Homo sapiens; identical to SEQ ID NO: 93106
  chr5:14774712-14774744
  Hypo

SEQ ID NO: 124367 - DNA, 33 bp, Homo sapiens; identical to SEQ ID NO: 93113
  chr5:14886060-14886093
  Hypo

SEQ ID NO: 124368 - DNA, 34 bp, Homo sapiens; identical to SEQ ID NO: 93116
  chr5:14895452-14895486
  Hypo

SEQ ID NO: 124369 - DNA, 145 bp, Homo sapiens; identical to SEQ ID NO: 93125
  chr5:14967329-14967474
  Hypo

SEQ ID NO: 124370 - DNA, 28 bp, Homo sapiens
  chr5:15292060-15292088
  Hypo
aaataggaaaagctccggtttacagctc

SEQ ID NO: 124371 - DNA, 109 bp, Homo sapiens; identical to SEQ ID NO: 93177
  chr5:15499838-15499947
  Hyper

SEQ ID NO: 124372 - DNA, 995 bp, Homo sapiens
  chr5:15500299-15501294
  Hyper
agtcttcactcgctccggggacccgcaacaagtggccgccgcgccctccccggggaagccgcgggcgcgcaggggcagccgaaggaggcggtcgagccgcggagcccaggggcctgcccggctcagcgcccaccggaggggatcggggcgggcggatggggacccggcggcggcggcgcggtgagcctctgggcggccccggggcgcgggctgtgcgcggcgctgcgcccgccggcccccagcgcggattgtaagtgctgcagctgtgcccggccccgcctggagccaccgggggtgccaggaggggacgcagcaccccctcccactggagtgcggggacctctccaggccggaggtcggccccggagcttgggggggatgtgcagctaacggtcccgtcgggcgggctttcctcgggccgagcgcgcaggacgtgcgccgcagctatggagtgtcccgggagacggcgggcatgacggctacaggatgggcgcgaacaatggcaaacagtacggcagtgagggtgagtgggccgcccgtcctcagactcccggatcgcgtccctcctcccctttccctcgccctcccgactgggaagggaggttctcgcccgcggccgtgacgcaccccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctct

SEQ ID NO: 124373 - DNA, 22 bp, Homo sapiens
  chr5:15503235-15503257
  Hypo
aacaatagctgaggtcgggcgc

SEQ ID NO: 124374 - DNA, 30 bp, Homo sapiens; identical to SEQ ID NO: 93216
  chr5:15928261-15928291
  Hypo

SEQ ID NO: 124375 - DNA, 152 bp, Homo sapiens; identical to SEQ ID NO: 93228
  chr5:16032731-16032883
  Hypo

SEQ ID NO: 124376 - DNA, 1788 bp, Homo sapiens
  chr5:16178996-16180784
  Hyper
gcatattggagccagcgctcacagggcagaaccagacgagcctcactggaggcaaactgggaggtaggcgtgcgctgtccgtggtgctgaaagcttgaccggcgcgagctggagccgccaccggctgcctcggggtctcgccgggccttacctgctccgcgccctggaagcagatcttgcagatgggctggtggtgctggtgctggtgcccagcgcgctggtcgccgccgccactgctgctgctgcggctgctgcacaccgagcgcgtctcgggctggtctccggcgccccgccgctcgcgctcgccgcccgcgccggcctcagactccccggggccgcctttcgctgctgccgcctccgggaggcgcctcggaccttccccggagtcgccggccgccgccacttcctggccggcgggctgcaggggcaggggcggaggcggcagctcgtccgctcccctgcaccgcggggccacctcccctagcggctcgcttggccccgcggcgcgctcgggggtctcgggggacgcgggcagcggcggcaggtagcgcggggccgcggggaccggggccggctctcccggcggcggcgtcggcggcggcggcgggggaggttgcgggggaggctcggcgtccccgctctccgccccgcgacaccgactgccgccgtggccgccctcaaagctcatggttgtgccgccgccgccctcctgccggcccggctggcgggccgggctctggctgcagggaaagagagcgcggagggggcgggagggagaggggaaaaggagggagggggcccggacgcctggggctagggggcgggacggggaggggatgcggaaggttctgcagctgcggcggcggcaggcgcggccgttcggtggagccgccggctcggctctgatggaggcggcgccgaattcggctgcgcgtgagagccgcgccgcggaagggggggccggagaagcgagggggcgggagggaggagcggcgcggcgggggtgacggggcgcgggcgcggggtgggctgggggcgcggatcagtgggacggagttcggggttcggctccgagcgggcgggctggaagtgggggatccctcagccgcctccacgggccggccccgcgctcacgtcggttccggggcggatgacccctctccaaacggcgcagcgctgcggctctcgtgagctgggaagtagggggcaggggagaggccgcgggtccagaaaccgttactggatgggccggtgggatgtggcgcgggccgggtggggcgcgacagtctgagccgagacccgcgtgggcttaagggtgcgcgaggcgggtgccctgggcgcgcccgaactggctgagcagtggagcgggaaagggcgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgttgccgcatgaggaagcaaatgacaccgccccttaccctggaaaagtggctgcagccttccccggatcttagttttactcaccccgaagtcaatttctcggtaactccaccct

SEQ ID NO: 124377 - DNA, 97 bp, Homo sapiens; identical to SEQ ID NO: 93246
  chr5:16209234-16209331
  Hypo

SEQ ID NO: 124378 - DNA, 24 bp, Homo sapiens
  chr5:16466772-16466796
  Hypo
gaacttcaggccaggcgcggtggc

SEQ ID NO: 124379 - DNA, 24 bp, Homo sapiens
  chr5:16467096-16467120
  Hypo
tggggaggtcgtagatttcatcca

SEQ ID NO: 124380 - DNA, 152 bp, Homo sapiens; identical to SEQ ID NO: 93269
  chr5:16707883-16708035
  Hypo

SEQ ID NO: 124381 - DNA, 247 bp, Homo sapiens; identical to SEQ ID NO: 93270
  chr5:16744440-16744687
  Hypo

SEQ ID NO: 124382 - DNA, 182 bp, Homo sapiens; identical to SEQ ID NO: 40512
  chr5:16809241-16809423
  Hypo

SEQ ID NO: 124383 - DNA, 30 bp, Homo sapiens; identical to SEQ ID NO: 29492
  chr5:16934552-16934582
  Hyper

SEQ ID NO: 124384 - DNA, 61 bp, Homo sapiens; identical to SEQ ID NO: 93306
  chr5:16935556-16935617
  Hyper

SEQ ID NO: 124385 - DNA, 438 bp, Homo sapiens; identical to SEQ ID NO: 93307
  chr5:16935883-16936321
  Hyper

SEQ ID NO: 124386 - DNA, 249 bp, Homo sapiens; identical to SEQ ID NO: 93308
  chr5:16936584-16936833
  Hyper

SEQ ID NO: 124387 - DNA, 151 bp, Homo sapiens; identical to SEQ ID NO: 93364
  chr5:17203026-17203177
  Hypo

SEQ ID NO: 124388 - DNA, 475 bp, Homo sapiens; identical to SEQ ID NO: 93366
  chr5:17216663-17217138
  Hyper

SEQ ID NO: 124389 - DNA, 1538 bp, Homo sapiens
  chr5:17217681-17219219
  Hyper
gaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccggtaaggaggcgcgcccggtggccccgcgccgccgcggacccgggggcctccgtcccccaccgcgccgcgccccgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctggggggagggggctgtcggggagaggagctgcgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaaccgcattcttttcatgaatattcatcgaacgcttggccaggctccttatctgcgtccccagagacatttccgccttgaaacgaactcggtggacagcccttgcccatgtaattctcactctgctgaaattagcacagcacacatgggtgcattttttaggaccttgtacaggttgacaacacctctgtctcccccgcggccactcgcactgtggggcgggctaaaacccaacactagcgtcgaaatggccttctgctatagggttgtggaccgaccccccaccccc

SEQ ID NO: 124390 - DNA, 32 bp, Homo sapiens; identical to SEQ ID NO: 93401
  chr5:17275585-17275617
  Hypo

SEQ ID NO: 124391 - DNA, 30 bp, Homo sapiens; identical to SEQ ID NO: 93403
  chr5:17276405-17276435
  Hypo

SEQ ID NO: 124392 - DNA, 101 bp, Homo sapiens; identical to SEQ ID NO: 93407
  chr5:17311107-17311208
  Hypo

SEQ ID NO: 124393 - DNA, 30 bp, Homo sapiens; identical to SEQ ID NO: 93408
  chr5:17312415-17312445
  Hypo

SEQ ID NO: 124394 - DNA, 156 bp, Homo sapiens; identical to SEQ ID NO: 93410
  chr5:17327398-17327554
  Hypo

SEQ ID NO: 124395 - DNA, 107 bp, Homo sapiens; identical to SEQ ID NO: 93433
  chr5:17492061-17492168
  Hypo

SEQ ID NO: 124396 - DNA, 114 bp, Homo sapiens; identical to SEQ ID NO: 93436
  chr5:17502345-17502459
  Hypo

SEQ ID NO: 124397 - DNA, 152 bp, Homo sapiens; identical to SEQ ID NO: 93441
  chr5:17511936-17512088
  Hypo

SEQ ID NO: 124398 - DNA, 16 bp, Homo sapiens
  chr5:18111782-18111798
  Hypo
gcgagactctgtctca

SEQ ID NO: 124399 - DNA, 211 bp, Homo sapiens; identical to SEQ ID NO: 93676
  chr5:18393745-18393956
  Hypo

SEQ ID NO: 124400 - DNA, 30 bp, Homo sapiens; identical to SEQ ID NO: 93722
  chr5:21291802-21291832
  Hypo

SEQ ID NO: 124401 - DNA, 288 bp, Homo sapiens; identical to SEQ ID NO: 93731
  chr5:22852968-22853256
  Hyper

SEQ ID NO: 124402 - DNA, 51 bp, Homo sapiens; identical to SEQ ID NO: 93732
  chr5:22853518-22853569
  Hyper

SEQ ID NO: 124403 - DNA, 30 bp, Homo sapiens; identical to SEQ ID NO: 93735
  chr5:23530297-23530327
  Hypo

SEQ ID NO: 124404 - DNA, 30 bp, Homo sapiens; identical to SEQ ID NO: 93742
  chr5:24314566-24314596
  Hypo

SEQ ID NO: 124405 - DNA, 40 bp, Homo sapiens; identical to SEQ ID NO: 93748
  chr5:25656060-25656100
  Hypo

SEQ ID NO: 124406 - DNA, 25 bp, Homo sapiens
  chr5:26029110-26029135
  Hypo
gcgcccggcccgaagtaaggcattt

SEQ ID NO: 124407 - DNA, 17 bp, Homo sapiens
  chr5:27086133-27086150
  Hypo
tccgtctcaaaaaaaaa

SEQ ID NO: 124408 - DNA, 101 bp, Homo sapiens; identical to SEQ ID NO: 93752
  chr5:27267415-27267516
  Hypo

SEQ ID NO: 124409 - DNA, 62 bp, Homo sapiens; identical to SEQ ID NO: 93769
  chr5:27523953-27524015
  Hypo

SEQ ID NO: 124410 - DNA, 171 bp, Homo sapiens; identical to SEQ ID NO: 93778
  chr5:29478680-29478851
  Hypo

SEQ ID NO: 124411 - DNA, 99 bp, Homo sapiens; identical to SEQ ID NO: 93784
  chr5:30694338-30694437
  Hypo

SEQ ID NO: 124412 - DNA, 16 bp, Homo sapiens
  chr5:31035761-31035777
  Hypo
ccgtctaaaaaaaaaa

SEQ ID NO: 124413 - DNA, 147 bp, Homo sapiens; identical to SEQ ID NO: 40519
  chr5:31111601-31111748
  Hypo

SEQ ID NO: 124414 - DNA, 23 bp, Homo sapiens
  chr5:31134444-31134467
  Hypo
ttggccaggcaggtgcggtggct

SEQ ID NO: 124415 - DNA, 30 bp, Homo sapiens; identical to SEQ ID NO: 93790
  chr5:31182513-31182543
  Hypo

SEQ ID NO: 124416 - DNA, 563 bp, Homo sapiens
  chr5:31193869-31194432
  Hyper
agctgcagtttcagccgcgacagcaagaacggcagagccggcgaccgcggcggcggcggcggcggaggcaggagcagcctgggcgggtcgcagggtctccgcgggcgcaggaaggcgagcagaggtgggttcgggctccgttggctatgcatacatctccctttttttttttttaattctgtagcgttgatagaagccaatcagagagagagccctctccgcccggtgggtgccgcgccggagttgggagggatgctctcagcctgcgagcccgggtcggggcgggcgcgcgggtccggctgcgcgggcggcgctgctgccgctgctcaggaccgacgccgcttcccggggagcctgggcaccgctcctccgcctcctggtaagaccgatccgccgtggggctgggtgggggcaccgggaagcgggccgccgcagaagaacccgctgcctttctctacgccggcagaggctgccaggggagctctggcatttgcaaagttggctggtcaattaccaaagggcgctggtgcgtgcaggtcccgccgagccgtttggggcttgat

SEQ ID NO: 124417 - DNA, 84 bp, Homo sapiens; identical to SEQ ID NO: 93795
  chr5:31572153-31572237
  Hypo

SEQ ID NO: 124418 - DNA, 29 bp, Homo sapiens
  chr5:31621855-31621884
  Hypo
ttgatatcacagggccgggcgtggtggct

SEQ ID NO: 124419 - DNA, 78 bp, Homo sapiens; identical to SEQ ID NO: 93797
  chr5:31629209-31629287
  Hypo

SEQ ID NO: 124420 - DNA, 235 bp, Homo sapiens; identical to SEQ ID NO: 93798
  chr5:31634979-31635214
  Hypo

SEQ ID NO: 124421 - DNA, 329 bp, Homo sapiens; identical to SEQ ID NO: 93799
  chr5:31639603-31639932
  Hyper

SEQ ID NO: 124422 - DNA, 24 bp, Homo sapiens
  chr5:31662743-31662767
  Hypo
tttctttttttgagacggagtctg

SEQ ID NO: 124423 - DNA, 36 bp, Homo sapiens; identical to SEQ ID NO: 93801
  chr5:31664530-31664566
  Hypo

SEQ ID NO: 124424 - DNA, 101 bp, Homo sapiens; identical to SEQ ID NO: 93802
  chr5:31691579-31691680
  Hypo

SEQ ID NO: 124425 - DNA, 191 bp, Homo sapiens; identical to SEQ ID NO: 93803
  chr5:31738160-31738351
  Hypo

SEQ ID NO: 124426 - DNA, 182 bp, Homo sapiens; identical to SEQ ID NO: 93804
  chr5:31750531-31750713
  Hypo

SEQ ID NO: 124427 - DNA, 30 bp, Homo sapiens; identical to SEQ ID NO: 93805
  chr5:31769285-31769315
  Hypo

SEQ ID NO: 124428 - DNA, 30 bp, Homo sapiens; identical to SEQ ID NO: 93806
  chr5:31784008-31784038
  Hypo

SEQ ID NO: 124429 - DNA, 30 bp, Homo sapiens; identical to SEQ ID NO: 93807
  chr5:31796388-31796418
  Hypo

SEQ ID NO: 124430 - DNA, 30 bp, Homo sapiens; identical to SEQ ID NO: 93808
  chr5:31832893-31832923
  Hypo

SEQ ID NO: 124431 - DNA, 838 bp, Homo sapiens; identical to SEQ ID NO: 93809
  chr5:31854940-31855778
  Hyper

SEQ ID NO: 124432 - DNA, 39 bp, Homo sapiens; identical to SEQ ID NO: 93810
  chr5:31863261-31863300
  Hypo

SEQ ID NO: 124433 - DNA, 49 bp, Homo sapiens; identical to SEQ ID NO: 93811
  chr5:31889103-31889152
  Hypo

SEQ ID NO: 124434 - DNA, 28 bp, Homo sapiens
  chr5:31920417-31920445
  Hypo
aattttttctgagcgaaagatagagatt

SEQ ID NO: 124435 - DNA, 29 bp, Homo sapiens
  chr5:31921511-31921540
  Hypo
gggtgcagtggctcacgcctgtaatccca

SEQ ID NO: 124436 - DNA, 30 bp, Homo sapiens; identical to SEQ ID NO: 93814
  chr5:31924663-31924693
  Hypo

SEQ ID NO: 124437 - DNA, 30 bp, Homo sapiens; identical to SEQ ID NO: 40523
  chr5:31982994-31983024
  Hypo

SEQ ID NO: 124438 - DNA, 55 bp, Homo sapiens; identical to SEQ ID NO: 93818
  chr5:32048718-32048773
  Hypo

SEQ ID NO: 124439 - DNA, 30 bp, Homo sapiens; identical to SEQ ID NO: 93823
  chr5:32331996-32332026
  Hypo

SEQ ID NO: 124440 - DNA, 24 bp, Homo sapiens
  chr5:32526558-32526582
  Hypo
tgaaatccttctccacgccgggcg

SEQ ID NO: 124441 - DNA, 30 bp, Homo sapiens; identical to SEQ ID NO: 93825
  chr5:32616284-32616314
  Hypo

SEQ ID NO: 124442 - DNA, 40 bp, Homo sapiens; identical to SEQ ID NO: 93827
  chr5:32709839-32709879
  Hyper

SEQ ID NO: 124443 - DNA, 870 bp, Homo sapiens; identical to SEQ ID NO: 93828
  chr5:32710093-32710963
  Hyper

SEQ ID NO: 124444 - DNA, 1829 bp, Homo sapiens
  chr5:32711023-32712852
  Hyper
atgtgtgcgtgcgcgcgcgcatttctctactttaaagcacgtttccttttttgaagccaggagctggagagcgtggaaagggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggcgcgaatcaatgagatcaaatgcgagggagatgcaccgtcaattacaaacacttggacaagtctaactttttttttcttctacaaaaacgctttcaaaagcaaccttagcaacgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgggtgcgcgcgggcactcgttcaggtatgcgccgtgtggctgcgacaacctttgacgaccgcccatcgcggtgtacgtagagggtcccag

SEQ ID NO: 124445 - DNA, 79 bp, Homo sapiens; identical to SEQ ID NO: 40525
  chr5:32750220-32750299
  Hypo

SEQ ID NO: 124446 - DNA, 45 bp, Homo sapiens; identical to SEQ ID NO: 93835
  chr5:32835693-32835738
  Hypo

SEQ ID NO: 124447 - DNA, 113 bp, Homo sapiens; identical to SEQ ID NO: 93836
  chr5:32855659-32855772
  Hypo

SEQ ID NO: 124448 - DNA, 21 bp, Homo sapiens
  chr5:32937597-32937618
  Hypo
ccatcacgtccagcctgtgaa

SEQ ID NO: 124449 - DNA, 30 bp, Homo sapiens; identical to SEQ ID NO: 93838
  chr5:33138834-33138864
  Hypo

SEQ ID NO: 124450 - DNA, 96 bp, Homo sapiens; identical to SEQ ID NO: 93839
  chr5:33162506-33162602
  Hypo

SEQ ID NO: 124451 - DNA, 22 bp, Homo sapiens
  chr5:33201158-33201180
  Hypo
ccgcgcccggccccagtgtctt

SEQ ID NO: 124452 - DNA, 25 bp, Homo sapiens
  chr5:33234426-33234451
  Hypo
tgagctgacacgcctggctgaattt

SEQ ID NO: 124453 - DNA, 79 bp, Homo sapiens; identical to SEQ ID NO: 93843
  chr5:33272980-33273059
  Hypo

SEQ ID NO: 124454 - DNA, 36 bp, Homo sapiens; identical to SEQ ID NO: 93844
  chr5:33286168-33286204
  Hypo

SEQ ID NO: 124455 - DNA, 81 bp, Homo sapiens; identical to SEQ ID NO: 93845
  chr5:33298096-33298177
  Hypo

SEQ ID NO: 124456 - DNA, 65 bp, Homo sapiens; identical to SEQ ID NO: 93847
  chr5:33442966-33443031
  Hypo

SEQ ID NO: 124457 - DNA, 97 bp, Homo sapiens; identical to SEQ ID NO: 93848
  chr5:33509494-33509591
  Hypo

SEQ ID NO: 124458 - DNA, 197 bp, Homo sapiens; identical to SEQ ID NO: 40531
  chr5:33550087-33550284
  Hypo

SEQ ID NO: 124459 - DNA, 157 bp, Homo sapiens; identical to SEQ ID NO: 93850
  chr5:33596013-33596170
  Hypo

SEQ ID NO: 124460 - DNA, 190 bp, Homo sapiens; identical to SEQ ID NO: 40532
  chr5:33880065-33880255
  Hypo

SEQ ID NO: 124461 - DNA, 502 bp, Homo sapiens; identical to SEQ ID NO: 29513
  chr5:33892054-33892556
  Hyper

SEQ ID NO: 124462 - DNA, 757 bp, Homo sapiens
  chr5:33936153-33936910
  Hyper
agctcaactctccctcgcggcgcgggcgcggctgggttcagcacctcggaaagcgcccctcgcggcgccccgggattacgcatgctccttggggcccgccgccttggccgtgcaagtgccaccgtaactggtgagagccgctggcaacccacccggagttgacaaccgcggagagacgcagacacccactgacctccaggaagctgagcgtggtggatggaactctacgatctctttctctccaaggacggaaacctcatccaagcagtcccagaggaaacggataaaggtatttgaaagggagcgagcggccccaaatcgcacaattgagcggctgggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagc

SEQ ID NO: 124463 - DNA, 209 bp, Homo sapiens; identical to SEQ ID NO: 93860
  chr5:34555944-34556153
  Hypo

SEQ ID NO: 124464 - DNA, 37 bp, Homo sapiens; identical to SEQ ID NO: 29517
  chr5:34655873-34655910
  Hyper

SEQ ID NO: 124465 - DNA, 70 bp, Homo sapiens; identical to SEQ ID NO: 93862
  chr5:34656351-34656421
  Hyper

SEQ ID NO: 124466 - DNA, 320 bp, Homo sapiens; identical to SEQ ID NO: 93863
  chr5:34656642-34656962
  Hyper

SEQ ID NO: 124467 - DNA, 105 bp, Homo sapiens; identical to SEQ ID NO: 93864
  chr5:34839926-34840031
  Hypo

SEQ ID NO: 124468 - DNA, 397 bp, Homo sapiens; identical to SEQ ID NO: 93866
  chr5:35229693-35230090
  Hyper

SEQ ID NO: 124469 - DNA, 30 bp, Homo sapiens; identical to SEQ ID NO: 93893
  chr5:36127942-36127972
  Hypo

SEQ ID NO: 124470 - DNA, 20 bp, Homo sapiens
  chr5:36541411-36541431
  Hypo
ttaaaacaggccgggcgtgg

SEQ ID NO: 124471 - DNA, 69 bp, Homo sapiens; identical to SEQ ID NO: 93898
  chr5:36606740-36606809
  Hyper

SEQ ID NO: 124472 - DNA, 86 bp, Homo sapiens; identical to SEQ ID NO: 93899
  chr5:36607023-36607109
  Hyper

SEQ ID NO: 124473 - DNA, 30 bp, Homo sapiens; identical to SEQ ID NO: 93900
  chr5:36607317-36607347
  Hyper

SEQ ID NO: 124474 - DNA, 454 bp, Homo sapiens; identical to SEQ ID NO: 93901
  chr5:36690192-36690646
  Hyper

SEQ ID NO: 124475 - DNA, 30 bp, Homo sapiens; identical to SEQ ID NO: 93902
  chr5:36693244-36693274
  Hyper

SEQ ID NO: 124476 - DNA, 30 bp, Homo sapiens; identical to SEQ ID NO: 93904
  chr5:36938092-36938122
  Hypo

SEQ ID NO: 124477 - DNA, 36 bp, Homo sapiens; identical to SEQ ID NO: 93905
  chr5:36985760-36985796
  Hypo

SEQ ID NO: 124478 - DNA, 21 bp, Homo sapiens
  chr5:37255526-37255547
  Hypo
tcttggcggtgggtgcaggac

SEQ ID NO: 124479 - DNA, 101 bp, Homo sapiens; identical to SEQ ID NO: 93908
  chr5:37371474-37371575
  Hyper

SEQ ID NO: 124480 - DNA, 210 bp, Homo sapiens
  chr5:37834615-37834825
  Hyper
cgcaccccttgcccacgggtcggtaggccacacagccatcaggctggcttggggtacgtgcggggctggctgcgggtgggggtgcgagggggtccgccggcggcccccccgcggggagggaacggttcttacagtcactgctcagcgcgaagggcgcgcggcggcggccgagggagcggtcttcggcgggcgcctcgggaggcctcttac

SEQ ID NO: 124481 - DNA, 4113 bp, Homo sapiens
  chr5:37836626-37840739
  Hyper
gctggtttgcaaactcgggaaaaagctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaacactgagcaagagtcgagcgcgttctaacatctccgcagcaggggccggaagagttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacaggagaaaaaggggtcattaaaataataacctcaatggcctagtggagtctcaagaatacgttcgagacagagatttgaatccaggactggcaagaaagcccctctcctaacctcgacggggatggttagttggggtggagggcgttaggaacgtgcaggcaaccgggtgaggaatgtagctttgccagacctcgcccggaggaggtgagccctccatttttaggttctcagcacctttgcagcagcccctcccccggcctgcgcttttccttggcacagatcaaaacaagctcaatagtaagttgcactcttggcaatgatagtatctctgcacgtccagagaggacacatttcgacggcggtgggttcgaagatgacccaagccctgaatcgttctgtgacttgacggaagagcacctggccgagtcggggaaggaaactgcccctcttgggcattccgggtccaggcgcatctggggctccacagatctttgcccacgtggaaaaggcaacatgcccctccgaaaggccggcctctctccggttctacttttctctctcctcgcatagcttaggttccctctagtctttccactttctactctcaccgtttgctctggggtccagacgcacccctctgactagggcgcccttcagccggccgcacccacccgcgacgcaggcaccacccgctccctgctccccggcccgctccctcacttacctcggatcgggtctccgcagaccctaggttggacattaactccaggtgccccaagtcccagccaggagacccatccgggctgatggctggagcgcggagccccgcccaacaggtcaggggcaagagttcgcaatcctggggtcgcgcggggcagcaagggcgcgctggaggcggcggccaagactcccgccgccgccgccgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatccgaacgagacaccacgtcaaccggcgcggggagtcccgtgaagacatgagggcgccaggagcgcaggctggtcttctagagcccgggctgggggtccggggtccggggtgggggaggggaggcgcggggccccgggagggaggggtcgggaggcgtcggctgggcctggcggtgggggaggagaggagagcagcgaggaggccctggagttcccgaggcggggggccggggtgcgagtgggcgacgcgaggcgcccctccctgggctgcagggagagcgctgagagcgcggagacgccgcggggctagcgccttctcctctccgggtggatcaaaaatcgagaggaatgtgcggcgctctgcgcgggccagccgaaaggggcaatccgaacttgaccgcggcgcccgcgccgggctttgcccccgcgcgccgcactgggagggtggcgctctgccggtgcagggcagcgccgggctttcctcgcgcctgtcgaaggccggccttcccgctcgggtgtctcgccctctcgcttctccgcagggcaggaggcagtggcgagaaaaggagctgccggccggagttctagcaccgagaaggagaggtgcggagcggccgggtgagggaagccgagtatttgccaggggacgctgcgagtggggatgaat

SEQ ID NO: 124482 - DNA, 17 bp, Homo sapiens
  chr5:38247048-38247065
  Hypo
gcttgggactgggtgcg

SEQ ID NO: 124483 - DNA, 1552 bp, Homo sapiens
  chr5:38257406-38258958
  Hyper
aacattgtttcctcccgcgctcccaaacataggctaactgtgaagagccaggacgcccaccgagtcctggcagcgttgcaaggtggggagggggcgggcgcggtcctgtcgctagtgactgcagatttcctctgcggggcacttcctacggcctttgatctttccccaggaactgccgagggccgcgtttgcctctaagtttattccctcttggtttatttattgtatctgctttctcttctcgctggtttggaggtcagaacgccagtatgcaacgggacttgtgtcccaggcagggtctcccctctccaggcactaccgcgaaatctggcaaaaggtacattttactgagtcctagggcagcaaattcagcggcggagaaagagtctttctccattcaggagacaacccaggaagcccgatcccgggatcagaggccaggaccccgccccggccccctgccccaggcccagctgggcgccgcccaggggcttttctcggtccgcctgggggctcgagctcgcgtccctccctaagacgccaggcttaacttggagtttcatctcctccccaggagggtctcaagttgccttcctctgccgggaagggcccccactcccccgctccaggccctaatctccacccggcgtcccagtctgagcggcctggcctcagctctccatctgcgagccttaaatcccatttatcttcttagcgcctcagacccggacggtcccgcctctcttcctctcacccccaccccacttgcaaatcacagacccccgtctacccctcgcatcccccaagtgcgctggaccaactacagcaacctttgaggtgttagaaaaagtcgcctagaggggcgcggcaggaggagggcccaggtggggtggagggggggcgccccaagatttcagggtgaggaccgcggagggtcctggacccgcagtcgcctaactcctgccctgcgtctccagtgcttgaagtcggtccctcccaggtccccaatctaggtcaccagcggggaagggctgcgctgggggtcgctagagagggtgaggggcgggctgtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcacgccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggtaat

SEQ ID NO: 124484 - DNA, 34 bp, Homo sapiens; identical to SEQ ID NO: 93926
  chr5:38259223-38259257
  Hyper

SEQ ID NO: 124485 - DNA, 778 bp, Homo sapiens
  chr5:38556207-38556985
  Hyper
ggcagaagttctgggcgctggagtccgcgtcccccaggacacgagggtgacccaagggcgcgcggagagcggcgggacccggagcggcgctctccggggtcactcccctaggacgctccgcagagctgggagcgctgccccaccccgcccgggccgcccctggggaccccgctcggggctccgcggctcccctgctccgcgccgcgcccacccgcccccaggactcacggtacgctcccgcgccgctatcttgccatcccctgccgccggctctgtagcctcggccgccgccccggggctgcccagatcccacagccgcccgggggcaggagccgccaaggagggggccgggcacaatgcgccgccgcctccgcagccgccgtctcgcctcccctgtgtcggcgcgaggctgcttgaggcggccacgggcgaagggcggcccgctgcgctccgcgaaccccgcgggccgccgccgccgccagagcctcccagaggcaacggtaacggccaccgccacggccgagtcgctccagccgggactgcggcgcgcgggggcggcgcctgcacgccgctcggctgggggcgcagcgggcccggccccgcccctgacccgcccctgcccccggccccggccccgccccaacccgcgcgcccccgccgatccccggccgcgcgcccgcgcgcgcgggtgctccaaggagtcggaggaacgcggccgcgcgacgggccccggacgccgagggtggtgcttcctccgagcctccggtggtgaggccgc

SEQ ID NO: 124486 - DNA, 72 bp, Homo sapiens; identical to SEQ ID NO: 93931
  chr5:38557271-38557343
  Hyper

SEQ ID NO: 124487 - DNA, 255 bp, Homo sapiens; identical to SEQ ID NO: 93935
  chr5:38845617-38845872
  Hyper

SEQ ID NO: 124488 - DNA, 182 bp, Homo sapiens
  chr5:38846307-38846489
  Hyper
gagccccgtgctgtgcgggaaagaatccgacaacttcgcagcccatcccggctggacgcgaccgggagtgcagcagcccgttcccctcctcggtgccgcctctgcccagcgtttgcttggctgggctaccacctgcgctcggacggcgctcggagggtcctcgcccccggcctgcctacctg

SEQ ID NO: 124489 - DNA, 34 bp, Homo sapiens; identical to SEQ ID NO: 93937
  chr5:39248593-39248627
  Hypo

SEQ ID NO: 124490 - DNA, 36 bp, Homo sapiens; identical to SEQ ID NO: 40535
  chr5:39343165-39343201
  Hypo

SEQ ID NO: 124491 - DNA, 634 bp, Homo sapiens; identical to SEQ ID NO: 93939
  chr5:39424929-39425563
  Hyper

SEQ ID NO: 124492 - DNA, 28 bp, Homo sapiens
  chr5:40066927-40066955
  Hypo
ggtccgggagtctggcggcagggatggc

SEQ ID NO: 124493 - DNA, 18 bp, Homo sapiens
  chr5:40294097-40294115
  Hypo
gcccggcctatttttctc

SEQ ID NO: 124494 - DNA, 93 bp, Homo sapiens; identical to SEQ ID NO: 93944
  chr5:40680534-40680627
  Hyper

SEQ ID NO: 124495 - DNA, 1131 bp, Homo sapiens
  chr5:40680963-40682094
  Hyper
cagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcc

SEQ ID NO: 124496 - DNA, 25 bp, Homo sapiens
  chr5:40861757-40861782
  Hypo
agagagaattcttggcggggcgcgg

SEQ ID NO: 124497 - DNA, 22 bp, Homo sapiens
  chr5:41041433-41041455
  Hypo
aatacacatcttcagcggggtg

SEQ ID NO: 124498 - DNA, 34 bp, Homo sapiens; identical to SEQ ID NO: 29546
  chr5:41510835-41510869
  Hyper

SEQ ID NO: 124499 - DNA, 49 bp, Homo sapiens; identical to SEQ ID NO: 93955
  chr5:41587836-41587885
  Hypo

SEQ ID NO: 124500 - DNA, 30 bp, Homo sapiens; identical to SEQ ID NO: 93956
  chr5:41746611-41746641
  Hypo

SEQ ID NO: 124501 - DNA, 22 bp, Homo sapiens
  chr5:41777225-41777247
  Hypo
ttacaaaaaaggggccgggtgc

SEQ ID NO: 124502 - DNA, 196 bp, Homo sapiens; identical to SEQ ID NO: 93958
  chr5:42123791-42123987
  Hypo

SEQ ID NO: 124503 - DNA, 114 bp, Homo sapiens
  chr5:42423455-42423569
  Hyper
tgctttcatttggaacgggcaggcggagaggaaggaagtgtattgcaactaccaatattttcctctaggaggagccgcgcagctcagttgagagtgacacgcaccaactccagc

SEQ ID NO: 124504 - DNA, 162 bp, Homo sapiens; identical to SEQ ID NO: 93961
  chr5:42423809-42423971
  Hyper

SEQ ID NO: 124505 - DNA, 544 bp, Homo sapiens; identical to SEQ ID NO: 93962
  chr5:42424615-42425159
  Hyper

SEQ ID NO: 124506 - DNA, 43 bp, Homo sapiens; identical to SEQ ID NO: 93967
  chr5:42915864-42915907
  Hypo

SEQ ID NO: 124507 - DNA, 88 bp, Homo sapiens; identical to SEQ ID NO: 29550
  chr5:42950080-42950168
  Hyper

SEQ ID NO: 124508 - DNA, 30 bp, Homo sapiens; identical to SEQ ID NO: 93969
  chr5:42950529-42950559
  Hyper

SEQ ID NO: 124509 - DNA, 1600 bp, Homo sapiens
  chr5:42950845-42952445
  Hyper
gaggcagggctaacccggggttgttaggattagaattccgaggctacaggaaacccggaattgctgagatgtgagtcacagggtgactcagcctcgttacgatgaaacagtaacttcctactacctagaaatcgcagccagggccagaccggtgtttgtcctaagtcggaacttgattgggctgagaaatcacattgtgactattccacgacttgaacaaggggtagaaatcgcaggcaccgcgaaatagaaacttcctaggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccaggcgcaactgggcgcaactggggcagctgcgacaccgaatccctcacatctgcaacctgggtgctgcggccactgagaaaatggaggcgcagaccaacgagcggtgccgcgaccgagagacctcggctggcgaaatggtggtgccgggagcctgcgagtgacgccagccggcggggttgtcaaggacaacattcgttttgacgcagccaatggcgccgtcaccaagaaaccatcgactctgagaaaaaagagaggttcggccaccgagaaactccgtacgacaagtgctgtggcagaaaaaccgcctactccgcgccacaggcaaaacagccaatggaaaccccaggtgctgcgaccgtgacaccggcactagagggtctcggatggagaaagcggcgcacggagaccaggaaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgccggactcagtgaaaccagccttgcctccagcggattccccggcttcgccggacgccacaggcagagtgccgcggggaaacctctggctccctaaaccgattagattgtgggagtgggggggacactcacaagttgtgtggaagggaaccagcggcaatgggacccggcgagcacttgcccgcagcaaatgcctgcgctgctgcaaaaaaaacaacttttggcgcaaagaatgttgcggccagagagcatccgctgtcgctgacaaaggagtagcaatggcaatgagaaaccgccggcgccacggccgaccgcggcggctcacgcctatgatcc

SEQ ID NO: 124510 - DNA, 1282 bp, Homo sapiens
  chr5:42991785-42993067
  Hyper
tggaggagccaaatccgtcccattctggatccttattccagctcctttccctctgcgaatcgcacttggtgggtcgcggggccctcagtaattagggatcacggatcagccaagaaaaatacaggttttcttaagcctgaagccactgacttgaggagggagcgtgggagtaatgtcagtagcagttttttatttcgttttcgtttttattttctagtcactaggccaccaaagaaagttccacccaacggccagtcgatccgtcgcagcgactctcttttccctgaacggagggtttatggctgacacctccacttgtttctcagagccggggctgactgccggctgcatctttgaatggcgaccaaaaaagacatgcatttgtctggcaaagtcgctggcgttcgcctggtgcccgcgcttgccgggtcctagagcagccagattttcacaccagcgagtccagcgcccagcgccactccgccttcggatcaccggtttctcacatccgcagcagcactggcctgacagttttccggttgcgacagcgctagttgagccaaacaaaacgttttcctgcttgctctgggcgtcccattctccatccgaggccttctagtcccggtgtcactgtcgcagcacctggcgttcgttagctctttcaccagcggcgcggagcgggcggttttgctgtcacggcacatgtggcacggagtttctcggtggccgaaaccctcttttttctcagagtccagtttcttggtgacagcgctgttggttgcgccataaggaatgttgtccttgacaacccgccggccgcagtcattcgcaagctccaggcaccgacatttcgcagaactgaggtctctcggtctcagcacagctcgttgctcgatgcctccattttctcggggcgacagcactcaggtcgccgatctgagggattcggagcttccccagctggggtgagcctggcgttcccgggcggcggcggcggcgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttcttttccttttgttttgttttgagacagagtctcgccgtgtcgcccagc

SEQ ID NO: 124511 - DNA, 240 bp, Homo sapiens; identical to SEQ ID NO: 93977
  chr5:42993307-42993547
  Hyper

SEQ ID NO: 124512 - DNA, 1581 bp, Homo sapiens
  chr5:42993847-42995428
  Hyper
ccaaagcctcaagtttctaagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagcaatttccgccgaacgcgactttttcctcttgtggaccaagtcgggatatatcagctactacgattttttagtcgtaaacaggtttaaccatgactgggttttgttggtttcttgttgttgttgttgtttgtttttgtttttgtcctaagaaatgtagacttaggtgtaacatgtaccggtttagatctaacagggatatcctaatcacagaattgcttcttttggcaatacttgtaatttctgctttgtagggttggttctctctaatttttgcttatttttaaatgctctttttgtgtcttttgctctgagaacaatgctaccggtagtttccagtgtgtttgctttgcctttttatttgaattttagaatttattattttaaaattttatcttatttaaatgttattcatttttcttctactaattttgagtatcacagcttcgtactccttgacttgcattctctcaggagctggggagccaagctcggtctccgcttcggtggtttcaggtcccgggttctgtctggcggctctgcttctaatgcggagctggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccggctcttttcctgtcacaacacattaaaacgtgttaaaacacattaaacggattaaacacattaaacggattaaaacacattaaaacgtcacaacacatttaaacagagtcggtccattcctccagacagtatgtttcgggatggaagcacccctcctaagaatccgcagtttctttctagcagcaccgttatggcgcctaaacggatatttgtttggcaataccagcgctatccgctaggtgccggcgcttgctgagtctcagcgccgccagattcttgctagcgaggtccagagcagtgcagagacctagcggacagttttccggtggcagcaatgctcatttcccggacacagatggtttttggcccctgaagaactctttaatccctgcgttttgtagcgctcgttctctgtaaggtttgcttagtatccgtttcatttcgacttcttttctcgctgtttttctgtcggaattacgatttgttttgttt

SEQ ID NO: 124513 - DNA, 199 bp, Homo sapiens; identical to SEQ ID NO: 7810
  chr5:43008737-43008936
  Hyper

SEQ ID NO: 124514 - DNA, 679 bp, Homo sapiens; identical to SEQ ID NO: 7809
  chr5:43007818-43008497
  Hyper

SEQ ID NO: 124515 - DNA, 30 bp, Homo sapiens; identical to SEQ ID NO: 93983
  chr5:43017284-43017314
  Hyper

SEQ ID NO: 124516 - DNA, 1003 bp, Homo sapiens
  chr5:43017701-43018704
  Hyper
agctctctcccaggacgagccacatccgccccattcacggtccttattccagctcctttccctctgcgaatcacactgggtgggtcgctgggggcctcggtaattacggattatggcacagccaagaaaaatacaggttttcttaagcctgaagccactgacttgaggggggagagtaggagtaatgccagcagcagttttgtatttggtttttgtttttatattctagtctctaggccacaagacaatgttgcacccagtgccagtcgatccgtcacggcgccgcaaactttccctgaacggagggtttgtggctgacatctctagtttctcagagcctgggagtgatcactggctgcaccgctgatggcgcccaaaagaacgcgcatttgtctttggcaacagcgctgggtttcgcctcgtgcccgcgcctgaagggtcctagcgccgccagattctcacactcgcgggtccagcgcccagcgctgctcctcccaccagtcatcggtttctcacacgcacttcattggcagcactggcgagtcagttttccggtggcggcggcgctagttggtctgcacgaaacgtttcccttctcgctccgtgtgtcccattctccatcccacgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcgccgatctgagggcttcggagtaccggccgggcgcggtggctcacgcctgtaat

SEQ ID NO: 124517 - DNA, 343 bp, Homo sapiens; identical to SEQ ID NO: 93986
  chr5:43019004-43019347
  Hyper

SEQ ID NO: 124518 - DNA, 237 bp, Homo sapiens; identical to SEQ ID NO: 29565
  chr5:43019650-43019887
  Hyper

SEQ ID NO: 124519 - DNA, 30 bp, Homo sapiens; identical to SEQ ID NO: 93988
  chr5:43023202-43023232
  Hypo

SEQ ID NO: 124520 - DNA, 198 bp, Homo sapiens; identical to SEQ ID NO: 93989
  chr5:43040830-43041028
  Hyper

SEQ ID NO: 124521 - DNA, 32 bp, Homo sapiens; identical to SEQ ID NO: 29567
  chr5:43043256-43043288
  Hyper

SEQ ID NO: 124522 - DNA, 25 bp, Homo sapiens
  chr5:43105351-43105376
  Hypo
agcaagactccgtcccccccaaaaa

SEQ ID NO: 124523 - DNA, 132 bp, Homo sapiens; identical to SEQ ID NO: 93992
  chr5:43173337-43173469
  Hypo

SEQ ID NO: 124524 - DNA, 1354 bp, Homo sapiens; identical to SEQ ID NO: 93993
  chr5:43191786-43193140
  Hyper

SEQ ID NO: 124525 - DNA, 24 bp, Homo sapiens
  chr5:43215538-43215562
  Hypo
ctttttttcttttttcgagatgga

SEQ ID NO: 124526 - DNA, 30 bp, Homo sapiens; identical to SEQ ID NO: 93995
  chr5:43233280-43233310
  Hypo

SEQ ID NO: 124527 - DNA, 553 bp, Homo sapiens
  chr5:43396928-43397481
  Hyper
actggtatctgtagtcgtggctgccgtggaccaggagagactgaagtggaaaacagcgggcggtagccgaagcagagagcaaggaagagcgcgggaagtgcagagcgacagcaacaagaaaggggtggcgcgggacgtcgtttacctgggcgacgtccagccgcccttcccgcctctgcgcgtacgcaacctgcttggcgccactgacctggtgaggaggcttctttaaggccgtggacggttcctacccgcgcgcggagaggaccgacgtgaagaagctgccaaagtataacaagtactacgcgaagggtaggtagggtggagtcccaggcagcgcgtgacggccggatgcccagacgcgcacgtcgcccgcaggcgcacgcctggacccgggggagccggctggggcgcccaggaccaggcctagcctaccgcgggctgcccttcacagagctgcaggagaaaacgttgtattgtgcacgcattccctaacccttactagtttttttttttttaattgatcggccagcttttgatgcgggtatgttaaaat

SEQ ID NO: 124528 - DNA, 42 bp, Homo sapiens; identical to SEQ ID NO: 93998
  chr5:43402630-43402672
  Hypo

SEQ ID NO: 124529 - DNA, 197 bp, Homo sapiens; identical to SEQ ID NO: 94000
  chr5:43740546-43740743
  Hypo

SEQ ID NO: 124530 - DNA, 837 bp, Homo sapiens; identical to SEQ ID NO: 94001
  chr5:44388215-44389052
  Hyper

SEQ ID NO: 124531 - DNA, 174 bp, Homo sapiens; identical to SEQ ID NO: 29574
  chr5:44389326-44389500
  Hyper

SEQ ID NO: 124532 - DNA, 601 bp, Homo sapiens; identical to SEQ ID NO: 94003
  chr5:44389793-44390394
  Hyper

SEQ ID NO: 124533 - DNA, 162 bp, Homo sapiens; identical to SEQ ID NO: 94004
  chr5:44492868-44493030
  Hypo

SEQ ID NO: 124534 - DNA, 43 bp, Homo sapiens; identical to SEQ ID NO: 40542
  chr5:44637083-44637126
  Hypo

SEQ ID NO: 124535 - DNA, 21 bp, Homo sapiens
  chr5:44939696-44939717
  Hypo
gaaggtggtgctgggcgcggt

SEQ ID NO: 124536 - DNA, 24 bp, Homo sapiens
  chr5:45225641-45225665
  Hypo
aggggcccttcatcccgccactgg

SEQ ID NO: 124537 - DNA, 543 bp, Homo sapiens
  chr5:45695143-45695686
  Hyper
tttggtgagacctcacgtcagggactatccaagtgcaaattgcccttcttttgcctgccggccgctgtttctgagtaaacacagcgaggataaccagcgcctataaagaaaaacagactaaacacactccccaggggcgagcgcggcaggaactgctcgggcttgtgaatcgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacccggaggcgccgagtggagcctgcttagcccgagccgacgccgccggcagcgccaccccccgcccgccctcctagtccc

SEQ ID NO: 124538 - DNA, 191 bp, Homo sapiens
  chr5:45695906-45696097
  Hyper
gcctctgcatgaagccgtactgccgccggggcccctcggcgtcttcgaagccccccgccggctcctcgccgccgccgccgccgccgccaccgccgccaccgccgtccaccttgaagcacacggagttgccgtgctccttcgcgccggccccgccgccccccggcggggtgcccaggcgcttctcggccgcg

SEQ ID NO: 124539 - DNA, 259 bp, Homo sapiens
  chr5:45696299-45696558
  Hyper
agcccagctgcccgtcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgccggagctaggcgaggctcagctcggctcagccctcgcgccccagcgcctcccctcggctgccctctgttggccagaaagggtctctccccgtccgctctccaca

SEQ ID NO: 124540 - DNA, 707 bp, Homo sapiens
  chr5:49736592-49737299
  Hyper
ctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggagggcgcgcatggcgccagagggtccgcctgggtcctcgtggagactgctccctcagctcgccgccgcgggtgtccagagtccctgcgcacactcgcaggtggcccggcgctcgcagccagtgccgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccggctgcagcctctccggcctccgccctctcggctctagcaggtc

SEQ ID NO: 124541 - DNA, 30 bp, Homo sapiens; identical to SEQ ID NO: 94038
  chr5:50217968-50217998
  Hypo

SEQ ID NO: 124542 - DNA, 311 bp, Homo sapiens; identical to SEQ ID NO: 94039
  chr5:50262925-50263236
  Hyper

SEQ ID NO: 124543 - DNA, 231 bp, Homo sapiens; identical to SEQ ID NO: 94040
  chr5:50263484-50263715
  Hyper

SEQ ID NO: 124544 - DNA, 1700 bp, Homo sapiens
  chr5:50264180-50265880
  Hyper
ttgcttatctgtattcgaggggttagtctccatcctaggattgtccctttcaaaaaaaattttttggatgcatctgttttcactttgcactttcaacgggctggagcagacaatagtgtgaaaaacatctgaaaatatgaggcgacagagctgcatgtgtgtttcatttctgcggtgttaggggagaaaataacaaaagaaacacacactacaacacacacgcacgcacgcacacacacacaccggcccaggacctcagcacaaagggcgcgctgacccagcgctaacacacaagacaaattaaagaaaggggcaaatcggaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcacaagagaccaagagatccggagtcaggctgtgaacttgggaaagataagttgcccggcgaggttggaggtagactgaggaacgcctttttttgtgaaggacacaaatatttgcagagtttaaagctgcaggaatacaaaagcaggagtgagattatctgattacggatacaggatgtccgagttgttgcctcccaaaaacgactgcgtaaaaaaaaataaataaaaggccagttcgaaaagtgaaattttaatatcagtgaaagcatcggagggactcggattgaacgcggcagctccggaactggacaacagctgcgtggtgcagccaatcccggggcctgtgggaacgagcgaccgatctcaggaccacgcgggcgagagcaaggagcctcccggccacacagccacaggcgctgcggaacccagcccggactctccccggctggagtgtgcgaagggcttcccgcccaggggcccagggtggtcttagtgaaaaagggatggcgctgcagcactgaccacgttgccctggtttctccatttctccttcccaagtctctgcctctgtttccccatgacccggaggacgcgcctacggaagagacgtctggtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccaccacgcaggagcagcgggggcacgcgcgtgttttcttgtggataactgcctcggacttggcggggccggtccccacctgaagctcacctcaggcagtcgctagaagttccaatccaatcgtgagctttcctctgggagggacaggatccccttcaactcctgaggctgctcctctgggcgaatcccacagtaattgcgcatttctctccct

SEQ ID NO: 124545 - DNA, 36 bp, Homo sapiens; identical to SEQ ID NO: 94045
  chr5:50674152-50674188
  Hyper

SEQ ID NO: 124546 - DNA, 30 bp, Homo sapiens; identical to SEQ ID NO: 94046
  chr5:50674452-50674482
  Hyper

SEQ ID NO: 124547 - DNA, 353 bp, Homo sapiens; identical to SEQ ID NO: 94047
  chr5:50674730-50675083
  Hyper

SEQ ID NO: 124548 - DNA, 70 bp, Homo sapiens; identical to SEQ ID NO: 94049
  chr5:50677690-50677760
  Hyper

SEQ ID NO: 124549 - DNA, 77 bp, Homo sapiens; identical to SEQ ID NO: 94050
  chr5:50678114-50678191
  Hyper

SEQ ID NO: 124550 - DNA, 30 bp, Homo sapiens; identical to SEQ ID NO: 94051
  chr5:50678447-50678477
  Hyper

SEQ ID NO: 124551 - DNA, 30 bp, Homo sapiens; identical to SEQ ID NO: 94052
  chr5:50679546-50679576
  Hyper

SEQ ID NO: 124552 - DNA, 518 bp, Homo sapiens; identical to SEQ ID NO: 94053
  chr5:50683061-50683579
  Hyper

SEQ ID NO: 124553 - DNA, 723 bp, Homo sapiens
  chr5:50685360-50686083
  Hyper
gggcgagcaagtaagcgggcgggcgggcgggcaagcgagcgagcgagcgagcgcgcgaccgcgggcgggccggcaagcgagcctccagcccagcgctcacggcgctccttgccccgcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactgtgagtggctctggggccgggcagggaatgcgagggggaaggagacgcagcgtgcgaggtgcgttcctggtacgcaggatcgcacggttttcaatcctgctcctgggcaggagtttggccggggctgcccctcatccttacccccctacccatgccccgggggacaggctacccggcgccggccgccagctgagggcggggaagctgggaggctccgtgcgccgggggagcagcatccaggtcccaacctcgtgggtgggctcatgcccttccacctcgcctgtacctgtgaaccggagaaacgccgtcctcccctc

SEQ ID NO: 124554 - DNA, 746 bp, Homo sapiens
  chr5:50694717-50695463
  Hyper
ttctacccccaggtgcgttgcccacgtccagcgggcagggcagcgcagcgcctgtctgcactcaggttaggggtgggaagtgctgggaatgggggacccggacactggtctaaccagccccgccactcccgcgggcaagtcagcccttgatcctttaaagcagggacaatcgacgtggtccgagagaggaaaataagggtatttctgggcccttctctttcaggagttgatcaggttggcagatctggagggctaatccaaacaaggcgcttgacttgtgaggtcgcgagtctagacagagctggtggctcggcggctccttatctttccctggaatcagccgaagaggcgctccccggcccactccgctcggctcgcccgggtccggagccaccgctcgacgcagacggcacaacaaacagcacctgaggctttatagctcgctttattgtttaatggagaatgcggcataacattcatttgtcttcttggttccgcgacctggccgctttgcagccacagacgctgggtacgggcgtgcgccagcgcccggccgttatggtccccatgttgagcagcgccgggcgttccgcttcggcatcgcgcgtgtaagcgcgcacggctctgtccgtgcgccctcaggcccctggagaggtacccagctgcagcccctttcttgcttccaaagcccggaggcggaagggtggagggacagtgaaagaaagcttaggcgaggtgtctttgac

SEQ ID NO: 124555 - DNA, 30 bp, Homo sapiens; identical to SEQ ID NO: 94064
  chr5:51759873-51759903
  Hypo

SEQ ID NO: 124556 - DNA, 292 bp, Homo sapiens; identical to SEQ ID NO: 94066
  chr5:52285516-52285808
  Hyper

SEQ ID NO: 124557 - DNA, 30 bp, Homo sapiens; identical to SEQ ID NO: 94069
  chr5:52775107-52775137
  Hyper

SEQ ID NO: 124558 - DNA, 531 bp, Homo sapiens; identical to SEQ ID NO: 94070
  chr5:52775392-52775923
  Hyper

SEQ ID NO: 124559 - DNA, 390 bp, Homo sapiens; identical to SEQ ID NO: 94071
  chr5:52776428-52776818
  Hyper

SEQ ID NO: 124560 - DNA, 139 bp, Homo sapiens; identical to SEQ ID NO: 94072
  chr5:52778602-52778741
  Hyper

SEQ ID NO: 124561 - DNA, 41 bp, Homo sapiens; identical to SEQ ID NO: 94073
  chr5:52888050-52888091
  Hypo

SEQ ID NO: 124562 - DNA, 23 bp, Homo sapiens
  chr5:53300030-53300053
  Hypo
ttaaatattctcggccgggtgtg

SEQ ID NO: 124563 - DNA, 30 bp, Homo sapiens; identical to SEQ ID NO: 94080
  chr5:53674661-53674691
  Hypo

SEQ ID NO: 124564 - DNA, 35 bp, Homo sapiens
  chr5:53814382-53814417
  Hyper
ctgtccctgggttcccgcggcggctcggtcccccc

SEQ ID NO: 124565 - DNA, 30 bp, Homo sapiens; identical to SEQ ID NO: 94085
  chr5:54042403-54042433
  Hypo

SEQ ID NO: 124566 - DNA, 591 bp, Homo sapiens
  chr5:54179554-54180145
  Hyper
cctccgggaaggccacgcggaggtgaggaacaggtcctgccctggaggcgccagccgcaccgaccgggagatggaagtttttcgcggcggcgccccagccacttcgcagggccgagcggtctcctccaccggccgcccggctcaggaatgccctgcctgcgagtcaaagtcggggtcgcggcggggcgaacctggcccagcattgcctggggccctcaggagcgccgagggggtctccctgccagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcgggggcagggccggggcggggagagccatttgcatcctgaagctgttgcgccccttcagcgcaaggagcgggctgggccttta

SEQ ID NO: 124567 - DNA, 336 bp, Homo sapiens; identical to SEQ ID NO: 94089
  chr5:54472206-54472542
  Hyper

SEQ ID NO: 124568 - DNA, 840 bp, Homo sapiens
  chr5:54516334-54517174
  Hyper
gtggctcaggttcaacgcgctccggctgcagtctgtgcgcagcccccggaaggcgccatgcaggttcccgggcctggtgtcagtattcgcgggctctggcagcagtcggggccgcttgggatcgcggctctgaagggcttcatcgcagcgctcggaaatctccctcaggatggcgtccacttccgcgcaatcctgccccgcagcgctgaccaactcctccaggctccttttggccttcgccttgagcaggaagggctcggccgccgccccacaatcccgggactgtgtgatcatcagcttctacgaaagacagggaagagcgccgccctggggcctgccggaccctccgggttcggagcgtgcaaaaggtgacctaggcgcgctacgcaccacgcactcagcggtactctcctctcccgggcccccacgggtcccgatgctgggcggggatgcactgaactgttcagttccgacgtgctgcagttcccacacgcccgcgccccacttacatccagcaccgaggccaggtgccgggttcggctggcgagttccttcagctgcacgttccgctccttgagcgaggcgatctcctcctgtttctgggtcaatgtcacgtgcagctgcaggaggagacccaaacattcaggggtaggtactgtgctgggtctcgtctgcatatctggcatgaatcaaacccagatcctgacgtctcatcaggaactggggacgcacaggcatttacgctagtgagaataataatcaatttactttttttttaaaacaaagcacttggacaaaatttatctccattaatcctcggtgtagcgtgctgataaagag

SEQ ID NO: 124569 - DNA, 990 bp, Homo sapiens
  chr5:54518651-54519641
  Hyper
gagttgctggagagtcgttgacagttggctgggtttaccaccttcacgaccacgaaatctgaactagtctgatttgggagtgggggacacccccgctgttatttaactgccaggagactgcacttgcctgaaatgagatcatccaccgtgtctctgaaatcttgcagattgaagtctgcttccgtttggtgggaatggttctgaaaaaaaccagaggtgtacactggttaacgagtctggcgttagaaagccttcaataaatattggcgtccctgttaaaaatctggcaggcactatgcaatatatgcacgtaacacaactgcacttgtacccctaagtccccccaaataaaacaatttttgtggcgggtccggaaccctttctagaccaacagacctcctcccgggctcggcggcggtctgctcgcacttacgtcgccagcccagtctcgtacccgaaaattcaagccccatccgagacagggaacccagcaggcttgcactgccacggtggggagcgggacgcacggagcacgacactgactgggggaagggggcagcagttcgcggctcctgcagagcagctgcgtggcgggaatgggtccttccaccggcggtgcggcggccctgcgccggctccgggcagccgagtagcccgccacccaccaactagctaagcagccgcctctgtgaagctcggcggttccctgtgcgcctgcgaaattttgactccgactcaccagcgaccggccaccgagccgccgctgtaggagctgagagcacgtcttgaacaccggatctttccacccaagacccgacagcgtgcaggggcctcgagcagtaatttgaggccgcgtttcccgccaaggtttggccccagctaaccgccccacccatgcaaccgagcgggaagaaagctgtgattcgaggggccaggagaatacgggaaaagcttctgttctgcgcacagccagtgcggcctccattgctc

SEQ ID NO: 124570 - DNA, 216 bp, Homo sapiens; identical to SEQ ID NO: 94094
  chr5:54523786-54524002
  Hyper

SEQ ID NO: 124571 - DNA, 501 bp, Homo sapiens
  chr5:54527304-54527805
  Hyper
catacagtcctccagcgccgcctccgggtggtctcccagtcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaaggcgccgcagcagagggccagaagctgcttcacgcgcggcgggtgcacctccacctgcaacacagggcgcactcaaccccgctttgcggcttcccgggccccaggcccaccccagtatgacgcccggactttccccatcccttccagagagacagccggggctctgcctct

SEQ ID NO: 124572 - DNA, 41 bp, Homo sapiens; identical to SEQ ID NO: 94096
  chr5:54528342-54528383
  Hyper

SEQ ID NO: 124573 - DNA, 46 bp, Homo sapiens; identical to SEQ ID NO: 94097
  chr5:55309312-55309358
  Hypo

SEQ ID NO: 124574 - DNA, 167 bp, Homo sapiens; identical to SEQ ID NO: 94105
  chr5:55776589-55776756
  Hyper

SEQ ID NO: 124575 - DNA, 30 bp, Homo sapiens; identical to SEQ ID NO: 94106
  chr5:55777140-55777170
  Hyper

SEQ ID NO: 124576 - DNA, 39 bp, Homo sapiens
  chr5:56248218-56248257
  Hyper
aggcaagtgggggacggacggacgcgcgggcgcgggaca

SEQ ID NO: 124577 - DNA, 39 bp, Homo sapiens; identical to SEQ ID NO: 94108
  chr5:56346672-56346711
  Hypo

SEQ ID NO: 124578 - DNA, 876 bp, Homo sapiens; identical to SEQ ID NO: 94111
  chr5:57877797-57878673
  Hyper

SEQ ID NO: 124579 - DNA, 280 bp, Homo sapiens
  chr5:57878910-57879190
  Hyper
gttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcaggtgggtccataaagaaagagtggcctcgggaggaattgaaagagatgcttttccccttgctccgcgcacaagcagttcaacgtaaggaaaggtctaggcggtcacccgcggagatgcggctctgtgacatg

SEQ ID NO: 124580 - DNA, 339 bp, Homo sapiens; identical to SEQ ID NO: 94115
  chr5:58335014-58335353
  Hyper

SEQ ID NO: 124581 - DNA, 318 bp, Homo sapiens; identical to SEQ ID NO: 94116
  chr5:58335563-58335881
  Hyper

SEQ ID NO: 124582 - DNA, 50 bp, Homo sapiens; identical to SEQ ID NO: 94122
  chr5:59064594-59064644
  Hyper

SEQ ID NO: 124583 - DNA, 72 bp, Homo sapiens; identical to SEQ ID NO: 94124
  chr5:59188376-59188448
  Hyper

SEQ ID NO: 124584 - DNA, 603 bp, Homo sapiens
  chr5:59188904-59189507
  Hyper
ttggtggtgataagccgacttagatggagtatttgagaaaaggggaggtgaccctttgcctgaatgggggagggggcgctctccactcaccgcctgagtccctggaacgaggagggccaggacatcctggatttcttcaggccgggccggtggccggtctccaccgcgtaggaggtgcggtccatggcgcgacagtacaggtagcgctcggtgtccgagtagccgcgatgccggacgcggccggtggccccgctcgaggcgtagcggccgcgggcagccccgggcggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgctggcccgagc

SEQ ID NO: 124585 - DNA, 375 bp, Homo sapiens; identical to SEQ ID NO: 94127
  chr5:59189708-59190083
  Hyper

SEQ ID NO: 124586 - DNA, 30 bp, Homo sapiens; identical to SEQ ID NO: 94130
  chr5:60139344-60139374
  Hyper

SEQ ID NO: 124587 - DNA, 30 bp, Homo sapiens; identical to SEQ ID NO: 94131
  chr5:60182155-60182185
  Hypo

SEQ ID NO: 124588 - DNA, 37 bp, Homo sapiens; identical to SEQ ID NO: 94135
  chr5:62077372-62077409
  Hypo

SEQ ID NO: 124589 - DNA, 397 bp, Homo sapiens
  chr5:63254903-63255300
  Hyper
gcgagtgttgggacacgctaaacagaattattccccgatccaaaaaggacaagagcgtgaattaggaggaaaaattctacatcgtaaggataaaattgctctttcaggttttactgggggagccagctggagccttgggcacgcgcgccctggggaacctttcctctttgccgcccctgcgtgtcgcccctttaaagccttcttggtctctccaatcccaagagttccgcggcatcttgcgccactggctaaggcaaaaacctcaggtgtctacccgcgcttcagggcgccccagagcgtaggcggaggaacccagatcctgtaagtcagcagccgggagcgcctagcgcgctgcgagagcacagatggctggggaggcgcgcggattccaggcctc

SEQ ID NO: 124590 - DNA, 69 bp, Homo sapiens; identical to SEQ ID NO: 94140
  chr5:63257323-63257392
  Hyper

SEQ ID NO: 124591 - DNA, 250 bp, Homo sapiens; identical to SEQ ID NO: 94141
  chr5:63257611-63257861
  Hyper

SEQ ID NO: 124592 - DNA, 40 bp, Homo sapiens; identical to SEQ ID NO: 94142
  chr5:63373761-63373801
  Hypo

SEQ ID NO: 124593 - DNA, 764 bp, Homo sapiens; identical to SEQ ID NO: 94143
  chr5:63461355-63462119
  Hyper

SEQ ID NO: 124594 - DNA, 820 bp, Homo sapiens
  chr5:63801787-63802607
  Hyper
atcaatgtgcgggcccgcgaacaacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagcgcttccccggctctccttcaagctgaaggttaccgacccgcgcagccagccccagcactgtgagctgcgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgac

SEQ ID NO: 124595 - DNA, 810 bp, Homo sapiens
  chr5:63986174-63986984
  Hyper
aaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcaggtgggctgagagcccgcgcgtgcggcggctggccgagcccggggctagggaggcgacaagcggagccacgccagggccagggaggttcccccgcgtccccgctatccgccctaggttaggtccctacggaaggacgcggagcctctgagggcgggtgagggcagggagagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgctctcccctcgccgggaccagtcc

SEQ ID NO: 124596 - DNA, 30 bp, Homo sapiens; identical to SEQ ID NO: 94152
  chr5:64767606-64767636
  Hypo

SEQ ID NO: 124597 - DNA, 153 bp, Homo sapiens; identical to SEQ ID NO: 94154
  chr5:64860458-64860611
  Hypo

SEQ ID NO: 124598 - DNA, 32 bp, Homo sapiens; identical to SEQ ID NO: 40549
  chr5:65181746-65181778
  Hypo

SEQ ID NO: 124599 - DNA, 60 bp, Homo sapiens; identical to SEQ ID NO: 94156
  chr5:65220787-65220847
  Hyper

SEQ ID NO: 124600 - DNA, 30 bp, Homo sapiens; identical to SEQ ID NO: 29628
  chr5:65891802-65891832
  Hyper

SEQ ID NO: 124601 - DNA, 71 bp, Homo sapiens; identical to SEQ ID NO: 94163
  chr5:65893398-65893469
  Hyper

SEQ ID NO: 124602 - DNA, 67 bp, Homo sapiens; identical to SEQ ID NO: 94164
  chr5:66511784-66511851
  Hyper

SEQ ID NO: 124603 - DNA, 30 bp, Homo sapiens; identical to SEQ ID NO: 94165
  chr5:66673601-66673631
  Hypo

SEQ ID NO: 124604 - DNA, 145 bp, Homo sapiens; identical to SEQ ID NO: 94168
  chr5:67573236-67573381
  Hypo

SEQ ID NO: 124605 - DNA, 496 bp, Homo sapiens; identical to SEQ ID NO: 94169
  chr5:67583945-67584441
  Hyper

SEQ ID NO: 124606 - DNA, 30 bp, Homo sapiens; identical to SEQ ID NO: 94170
  chr5:67591271-67591301
  Hypo

SEQ ID NO: 124607 - DNA, 226 bp, Homo sapiens; identical to SEQ ID NO: 40551
  chr5:67840329-67840555
  Hypo

SEQ ID NO: 124608 - DNA, 49 bp, Homo sapiens; identical to SEQ ID NO: 94174
  chr5:68370981-68371030
  Hypo

SEQ ID NO: 124609 - DNA, 17 bp, Homo sapiens
  chr5:68391002-68391019
  Hypo
gtaatagcattataacg

SEQ ID NO: 124610 - DNA, 17 bp, Homo sapiens
  chr5:68391319-68391336
  Hypo
cccgcccaacataagca

SEQ ID NO: 124611 - DNA, 78 bp, Homo sapiens; identical to SEQ ID NO: 94178
  chr5:68475607-68475685
  Hypo

SEQ ID NO: 124612 - DNA, 1208 bp, Homo sapiens
  chr5:71014657-71015865
  Hyper
cttggggttggggtgcgaggcaaggcagggctggcgaggtggatgttgcagctgtcaccactgctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatctgtgcgcagagcctcgttcccaggcgcctggaacccggcgggcattgacgtcaagcgccggcggagcgctgcctacagacggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctgggacagcgtccgctaagtttccacccctcgaccattccctgtgtccgcggagtcccaccgcagagtgcgtgtgggtccggggctccttataactagggctggaagtgcgcacctgggctgggctcgcagccaaggcggcaacttcaggctccgaagcggtgtgttgcagatcgaagcgctgcaagaagtcttgaagaagctcaagagtaaacgtgttcccatctatgagaagaagtatggccaagtccccatggtaaggtttgtggtcactcccttcccgtgtttttccaagagaaagtacaccgccttgaatcgtacacacagtctt

SEQ ID NO: 124613 - DNA, 1211 bp, Homo sapiens; identical to SEQ ID NO: 94184
  chr5:71402862-71404073
  Hyper

SEQ ID NO: 124614 - DNA, 489 bp, Homo sapiens
  chr5:71404392-71404881
  Hyper
gccggggaccctgggcggggccgtgagggtccggcgggcacagcctcgggcgcacagagagaccgcccccagccccacccgagctgccgcagtgcctccggaccgcccgccacacctgcccccccacactgcggcgcccccgtcgggcacggctggctgggcttgcgctccgcccgggcctcgggctggcgggggccgcgcgcccccacctctcagtttgcctggctttgttgccctgggagtccctgggtgggcagctctggtctctgcctttccctttatccctggcgtcccggccctcccctcgctcctgacagaggtcgccgggtccctccgcagccccagcccgcgctctattctcctggggtggtgctgaagcgtttctccgggagacaccggttggtgggcgtggtgcagtccgcactgcggtctctacggcagcccgaggcggacaaagggcgttcacgcagccctcgttccccactcccc

SEQ ID NO: 124615 - DNA, 156 bp, Homo sapiens; identical to SEQ ID NO: 94187
  chr5:71491785-71491941
  Hypo

SEQ ID NO: 124616 - DNA, 30 bp, Homo sapiens; identical to SEQ ID NO: 40555
  chr5:72175493-72175523
  Hypo

SEQ ID NO: 124617 - DNA, 240 bp, Homo sapiens; identical to SEQ ID NO: 94189
  chr5:72236789-72237029
  Hypo

SEQ ID NO: 124618 - DNA, 406 bp, Homo sapiens
  chr5:72415759-72416165
  Hyper
gagcgcacgtcgtcccgtgacctggtggctccatattcgatggggagctcgcagcgagtcgcttccctctgtaaccccactccaggtctccagagcagtaggagggccacagggctgctgggtgtagtcgccccggacctcgcggtggccaaggccaaggcggccggggcacggtaccctgttcggcctgggccgcaaccacgaaggaggcggtggaggcgggggccggcgcttcctccgcgccccccacgccgccgctctctcgcgcccctatagaactgggcctcaggcctcgagggggagcgggcctcggcgggcggggcgcacagttccgccagccggcgggggcatctcaactcgccggccccgccaggtgtgcgggccaggcagccgtggaaggtgccca

SEQ ID NO: 124619 - DNA, 294 bp, Homo sapiens; identical to SEQ ID NO: 94192
  chr5:72497893-72498187
  Hyper

SEQ ID NO: 124620 - DNA, 30 bp, Homo sapiens; identical to SEQ ID NO: 94193
  chr5:72511476-72511506
  Hyper

SEQ ID NO: 124621 - DNA, 191 bp, Homo sapiens; identical to SEQ ID NO: 94194
  chr5:72512184-72512375
  Hyper

SEQ ID NO: 124622 - DNA, 663 bp, Homo sapiens
  chr5:72526037-72526700
  Hyper
gctactgctagccctcgccccagactgtccggttctcaggagggtttgcgcggcctgtttgccaagcctgggtaggcgggacagggggattcccaaggccgatcagattctatttactgccctcttccccaaccccggggccacctctgaggcatgaacccagagacgcgcgccctggtctgggaaagcaggaccgctgcgcccagcgcctcaggggtagaggcgggaacaggcccgcggtcgctttgctggcggggaagggcgatctgacgatcagggagttgcgcccctctctctgggcctcgtgaaggaacagagcaattacagcgctgggccggccacgtagtcctggggctaggtgggcccaatgctccgggccgcggggctggagcgcggaggctggagagggaggaggaccctccgcggctccaggcctcccagctggaggggctcacgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagttagggggctgcgctagcagggacatgtggggcaaaagagacgtattttaaaaccc

SEQ ID NO: 124623 - DNA, 552 bp, Homo sapiens
  chr5:72528095-72528647
  Hyper
atagactcagaaacccgggagagtttaggagaccgccgaggcgagcactttctctaacaatcgcgtgctgcagtcaggagagcccaggtggctgcggccgcccttaggagaccagtgatcatcccagccacctccctgcccagccccgggccgaactggaaaactcttaactttgggctttatttaaaacactcgggtttcgaaagccgggtcccctccgcaggccaggaggcctcagtgagcatcctgtgctgcgtggggagggcctggcagctggcggatccgtctgggctgcagctgcagggtcgggagctcttcttggactcggctcctttcagaaaactcttttcttgtcggatgtggtttccctttaattaatcactcatgcccgcgtgtccaccgcgccgcttccccactcttcctccagccccgcatgtgatctctatttggaggcaggagagctggtggagcatctggggttgccgcggaggtggttctgcctgccgctgggcttcgggccgccgcccagagacagagcgatatcctcccaga

SEQ ID NO: 124624 - DNA, 1643 bp, Homo sapiens
  chr5:72528993-72530636
  Hyper
gtgcaggctcctttccggaaagccctggccccaaaccccaacatcaagccactctcaggattgcggggcagtgggcaagacctgatccagagggtgtgcattaagccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggggctgaagagatcacacgcggcggggtgtggaacttcgaggggtgtcacggccagggctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccggcgagcccgccgcggaacaggccccgtaatcctccctggtcggcggatctcagtgggctctgtgcggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgtttttgtaggtgctcctgctgctgggcactttggtaccccttcccttccccgcccctccccgccccttcacacacacttgctctggtaaagaaaacatgtcccagatgaaagacgtttttttcaaacgtacatgtgttttgcagaaaacggaggtgacagggtgggataacgaggagaaaggaagggtggctttcctgcctcccccacccccgaaaggtcatcggagtcagaggggtaaccatcgggttaaaaagtattgtgggcagagttcagatgtccggtgaatcgcacggttctgccctgggggagatctgccttccacccccacccccgcggaatgacagaaagagttgggaggaccgtggggatgtagat

SEQ ID NO: 124625 - DNA, 233 bp, Homo sapiens
  chr5:72594173-72594406
  Hyper
agagctgggacaaaacgccggagcggcccggcgggggacgcacaggcgagtctcagggccccgccctctcccgtgtccccctgttctgcgcgggcgggctgtgcgggcctggccaggagccgggtcggaactccgtgcagcgatggcagctcgggcgcgcgccttgaggagccggtggggtgctgggggacggagaaggtcccaaggtccggggcgcgcgctttgctgccgct

SEQ ID NO: 124626 - DNA, 1202 bp, Homo sapiens
  chr5:72594770-72595972
  Hyper
aaagagaaaaggcaccgggcacggaggtttaatgtgaagcatgtgagcggggctcagtttacaggtacgcgggccgatggcgaagagcgctgtcaagcggcctcgaggatttcggggggtttgcgccgccgaggaaaccctacccggacgaggcgagcagcctggtggccctggcggccgcgagctcccggctgccaccgctaggcgcccccgcccggcccgccggcgctccgagggcaaacccgggcggcacagccgtgcgccctgggctccgcgcgcccaaggaaagggcttcccagtcaccctgcggcgacgcttctccctcccgggaatgacaccttcgctcgctttcacacagccaagccgttggagaggcagaaacagtgggtcccgagcccgcaggagaagttcccatcccgcccctctagccctcgggcgttggcagtggagtaacaaagacgctgccgcgccgttgaccccgaagaagctctgatgaaaaggagggcgggccgcgggataggagtttctacaattagttttttctgcctttacgttcccaagaagaagccgaggaagtagaaaggagagagatctgggaaaggcaagatccagaaatcaggagccattatgtttctcattttggagaaaaactgtaaaacagctcggcctcttgtccaccttgccccgaaggcaagtctggatatgaaaagaaaaaggcgggcaacggaggagatttatttttcattttaactttcctctcccaggcttcctcaccccctgcccccttcgattcctaggaggggcggccccagccctcggagccgattctcggcgctgcgctaggacatcagaggcgatacaggttcgatgttaaatgaaccttcaggccgccggacaatggcgcagacctcacacgggggcaccgcgccttcccccagccgtgctcggctcccgccgcttctttatttcacgtggtggaatcctccgcgtctcctacagccgccgaaccaatgggcagaccggggagagcgggacgcgcaggagagggtttgaaaggaggtgtgggttttaatttttaaagagcataattgggctgaggagggttattttttccttggccacgggaaaaaaaagaggaagaaggggaaaaaaaagtcaggcgaaacacaacacatttatctatcaaccgctagacaagacaa

SEQ ID NO: 124627 - DNA, 134 bp, Homo sapiens; identical to SEQ ID NO: 94206
  chr5:72596806-72596940
  Hyper

SEQ ID NO: 124628 - DNA, 72 bp, Homo sapiens; identical to SEQ ID NO: 7872
  chr5:72598030-72598102
  Hyper

SEQ ID NO: 124629 - DNA, 871 bp, Homo sapiens
  chr5:72598987-72599858
  Hyper
cgcaatgtggaagggcggcgagtcgccctcggggcccacagcgccgtcgggcaaagaaccagaggcgtggagcgaatgcagcgcccgggagtcagggctgttagtggcgtggcccgccgggcattgagctgtttcctccaacgcccggtcccccgcggcctaggcccagtgtttgcttttgcagatacgtcagagggaacattcaggaggggcgggctcccaggctcccaggagaccgcccggagcctccggagcgcgacgaggcgcggggcctcggagatctggcctgccagattgagggggaggggagggggcctggcccagcagctggacaggcgcgcagtgcccgcagcccgcgagtgggcgcccagctggcttcgcacgggtgaggggctcagcctgcacttccctcctccaccccgaccgccgaacgcgtcccggctggcttcagagtgcgcttctcgtggacgtgctgcgcgcaccctagggagatgcgcggcgtccgcgcgggtcagcgccccagtaccactccccagtgtactccccaggtacacgcttcccttgcgcggcgagtttcaactcaggtcagaacggagctgagcggtgggcggagtggagaaaggtcccggaaattggccaagagggggcggtttcgaggtagtgccttcgaagtgttgtccagaccagcagggagggtcgcctccacctgcggggcctcctccagctccacaaggtagccccgtagggacttgcagatctgccagacctagcagtgagaccactgctcccactgaatggcgccgcctgcgggctggcccaagctctatgcaccggctttatctcattttctcctcaccgttaataactggca

SEQ ID NO: 124630 - DNA, 30 bp, Homo sapiens; identical to SEQ ID NO: 7875
  chr5:72608427-72608457
  Hyper

SEQ ID NO: 124631 - DNA, 1174 bp, Homo sapiens
  chr5:72677145-72678319
  Hyper
gctaaaattaatctgcgctgggccacttgcagaaagcagaaccacctcccgcccccacctcgcctccagccgccggggttcaggcgtttgtgaaagacagaacctttgggctagggacccgggcactggtgcttcgaagtccgaatccgccggccgagaaaacgacaagagaaagaaaatccagcgggcgctctctccagcgccaggccggtgtaggagggcgctggggctcggcctgccacccctacccgacattgggaagcagcccctgcgctcccgcggcgcctcagcctccggtccccgccccgaggtgcgcgttcctcctcccgcatgcccgtctcgggccccacggagcaagaagatagacgatgacgaggcgcgcccatccatccgggccgacgaggtcaggcccgcgccacaggcaaaaattgcgcaagcccggccgcagggatttcgcgggcgcctgggtcccaggtgcgcggccgaaatcctcagggaaaatcccgaggggccaacggtctaggccacagggctgctgggcccgggcctggctcagagcgcattcgggcggggaggccgcacgccgcacccgggcctctcctccgagcccgaggcaggcactgagctccgggccagccaggtgcctcccggctggtgcgagaccccgggcctgctgggaggcgtgggcagggcagggcagggctgaaccccagcgactgaatctcgaaggcaggaggcctcggaggtcatcggcccagctcgcctgaaactgtccctgctcgtgccagggcgcgggcagaggagaaaggacagggcggagcaagcccactgcagaactgcggtcggtggctgcgaagggtccgggtcaccgcgctcccggacgccggaagccgcgctggcggggccgcggggagggaggctgggtaccggggccgtccggccggaggaagcggctccggccgcgctgtccgcgcttgggagccgcgtgcagggttcagccgtgtttcagttgccctctgacctgaccccgggcgcacaaaggcctcccgggtgcgccgccatggcccagtcttccagtcgctgccaaattaatgagcccacgtcaggttgggtttacagctcggccgggaagcagccgagtggaaaatgagctcggggccgctccagaggctcc

SEQ ID NO: 124632 - DNA, 874 bp, Homo sapiens
  chr5:72715262-72716136
  Hyper
gtagtggggagggggcgccaagagtaacaaagggagccagcggcctggtttgtttggattgccgggccggcgcgggagcggccgggcgcagctgaccacgggtacagataggttaatttccacatggagctgcagaaaccctatccgcgggttgcgaagcgtgggtcagccaaggcatgttaatctgtttagcatgtgcgccgcgcggaggagccagaccaccggggcgcaggaggcgcggccgcagccggcgctcctctgggggagttaataaagagcttaaggcaggcaagtaagtgtatggaggctgcgagcggcttcttgcgggcggcccgggggagggcgaggcccggctgcctgcgctcgcgttcccaggccctcggaaccgcgcgccctcgaggccgagcgagccccgccgcgccgagcctcccgggcgtccgcaggcctggcgcacaccgaagcggggggcgcagtactgctctcccgccccccggagccgagcctcttcgcgttcgcaccgtgaaaggaggggagcgaggggttagccatctcgaacatttttaactaatcaaaatatttgctgatgagtatttatttttacaagaactcggtttggctggagacttcccgagcaacaatatgggctgccgtattaggtttgtgacggagccaagtgtggttggggcttattgaatctgcgggccggagatcgctcgctccggagacgtttctccgttctggggaagcagctttcccaaaaccgtccttctgcagatggctcttagaacacaaccacatgtcccctaaagcacgggaagcttcgtgttttatgtttgggctgaatgaaaagaggaacgcacgctctttcctgccc

SEQ ID NO: 124633 - DNA, 30 bp, Homo sapiens; identical to SEQ ID NO: 94217
  chr5:72716375-72716405
  Hyper

SEQ ID NO: 124634 - DNA, 30 bp, Homo sapiens; identical to SEQ ID NO: 29666
  chr5:72731806-72731836
  Hyper

SEQ ID NO: 124635 - DNA, 152 bp, Homo sapiens; identical to SEQ ID NO: 94219
  chr5:72732228-72732380
  Hyper

SEQ ID NO: 124636 - DNA, 555 bp, Homo sapiens
  chr5:72732630-72733185
  Hyper
agcccggagcctctccgccccgccgggccccgcggccgccccttcctcacccggaaaatcgtggggaggcgcggcgtagcggccggacccctggcctccgcgtcgggctgcgccacgtggcagctcccagcgccctcccgtcccggcctcgcatgctgtcgggggagcgcctcgtcccactcaggccgaaaccccaggaaggaaatcactctgggctggggacgcggcctttctgctcgcggctgttgggtgatgtgcccgaggtttctctgcccttctccgggcgcaggccgttcattcgcgccgccgctcctgagggtcgctgggcgcagaaccgcctcggccgcggcccggccttaggcgcggcctcgcgcattcctgcgctcgccacagccggcgggaggcggggaagggagcagcccgggtggcttggagaacactgaacctttaattgggctataaatcagacaggggagtgcggtggagtttatgcaggtgtaaaaacagaggggaaagcccgggccgagcagccaaagcgcccgggcaggtcagaac

SEQ ID NO: 124637 - DNA, 87 bp, Homo sapiens; identical to SEQ ID NO: 94222
  chr5:72733501-72733588
  Hyper

SEQ ID NO: 124638 - DNA, 245 bp, Homo sapiens; identical to SEQ ID NO: 94223
  chr5:72740103-72740348
  Hyper

SEQ ID NO: 124639 - DNA, 1912 bp, Homo sapiens; identical to SEQ ID NO: 94224
  chr5:72742569-72744481
  Hyper

SEQ ID NO: 124640 - DNA, 499 bp, Homo sapiens; identical to SEQ ID NO: 94225
  chr5:72744697-72745196
  Hyper

SEQ ID NO: 124641 - DNA, 46 bp, Homo sapiens
  chr5:72746678-72746724
  Hyper
tcattccgttcatggcgcgggagatagactgcgttcgtttgtaact

SEQ ID NO: 124642 - DNA, 528 bp, Homo sapiens; identical to SEQ ID NO: 94227
  chr5:72746992-72747520
  Hyper

SEQ ID NO: 124643 - DNA, 30 bp, Homo sapiens; identical to SEQ ID NO: 94228
  chr5:72747820-72747850
  Hyper

SEQ ID NO: 124644 - DNA, 104 bp, Homo sapiens; identical to SEQ ID NO: 94234
  chr5:74061423-74061527
  Hypo

SEQ ID NO: 124645 - DNA, 67 bp, Homo sapiens; identical to SEQ ID NO: 29677
  chr5:74161713-74161780
  Hyper

SEQ ID NO: 124646 - DNA, 35 bp, Homo sapiens; identical to SEQ ID NO: 94236
  chr5:74162202-74162237
  Hyper

SEQ ID NO: 124647 - DNA, 110 bp, Homo sapiens; identical to SEQ ID NO: 94237
  chr5:74162506-74162616
  Hyper

SEQ ID NO: 124648 - DNA, 381 bp, Homo sapiens; identical to SEQ ID NO: 94238
  chr5:74348254-74348635
  Hyper

SEQ ID NO: 124649 - DNA, 511 bp, Homo sapiens; identical to SEQ ID NO: 94239
  chr5:74349496-74350007
  Hyper

SEQ ID NO: 124650 - DNA, 25 bp, Homo sapiens
  chr5:74536034-74536059
  Hypo
aatttttttttgagacggagtttcg

SEQ ID NO: 124651 - DNA, 125 bp, Homo sapiens; identical to SEQ ID NO: 94241
  chr5:74906134-74906259
  Hypo

SEQ ID NO: 124652 - DNA, 104 bp, Homo sapiens; identical to SEQ ID NO: 94242
  chr5:74907576-74907680
  Hyper

SEQ ID NO: 124653 - DNA, 42 bp, Homo sapiens; identical to SEQ ID NO: 94243
  chr5:75014106-75014148
  Hypo

SEQ ID NO: 124654 - DNA, 613 bp, Homo sapiens
  chr5:75377684-75378297
  Hyper
accgcctgtctccaccggctcctctgggcaggaggctccagcctgggggtgcctgacagctctccttccccggcgcctgtattatacatgtaacatttatatttctatccacacagcgttcattcagccatccattcaatcacccaggcatatttacacggatggaacacattcgcggagagatgtgtgtgtttgagttccaatcactgcagcccgtattggcgcggcgctttgtctcgctttgggtcaccaccacaggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 124655 - DNA, 155 bp, Homo sapiens; identical to SEQ ID NO: 94246
  chr5:75378559-75378714
  Hyper

SEQ ID NO: 124656 - DNA, 689 bp, Homo sapiens; identical to SEQ ID NO: 29683
  chr5:75379005-75379694
  Hyper

SEQ ID NO: 124657 - DNA, 857 bp, Homo sapiens; identical to SEQ ID NO: 94248
  chr5:75380067-75380924
  Hyper

SEQ ID NO: 124658 - DNA, 36 bp, Homo sapiens; identical to SEQ ID NO: 94249
  chr5:75587117-75587153
  Hypo

SEQ ID NO: 124659 - DNA, 21 bp, Homo sapiens
  chr5:75688128-75688149
  Hypo
acagagcgagactccgtctca

SEQ ID NO: 124660 - DNA, 30 bp, Homo sapiens; identical to SEQ ID NO: 94251
  chr5:75698244-75698274
  Hyper

SEQ ID NO: 124661 - DNA, 714 bp, Homo sapiens; identical to SEQ ID NO: 94252
  chr5:75699459-75700173
  Hyper

SEQ ID NO: 124662 - DNA, 17 bp, Homo sapiens
  chr5:75719149-75719166
  Hypo
aaaatggtgcttggtcg

SEQ ID NO: 124663 - DNA, 76 bp, Homo sapiens; identical to SEQ ID NO: 94254
  chr5:75743288-75743364
  Hypo

SEQ ID NO: 124664 - DNA, 30 bp, Homo sapiens; identical to SEQ ID NO: 40558
  chr5:75819580-75819610
  Hypo

SEQ ID NO: 124665 - DNA, 30 bp, Homo sapiens; identical to SEQ ID NO: 94256
  chr5:75913911-75913941
  Hypo

SEQ ID NO: 124666 - DNA, 89 bp, Homo sapiens; identical to SEQ ID NO: 40559
  chr5:75963986-75964075
  Hypo

SEQ ID NO: 124667 - DNA, 40 bp, Homo sapiens; identical to SEQ ID NO: 94258
  chr5:75965679-75965719
  Hypo

SEQ ID NO: 124668 - DNA, 30 bp, Homo sapiens; identical to SEQ ID NO: 40560
  chr5:75969716-75969746
  Hypo

SEQ ID NO: 124669 - DNA, 30 bp, Homo sapiens; identical to SEQ ID NO: 94260
  chr5:75996136-75996166
  Hypo

SEQ ID NO: 124670 - DNA, 580 bp, Homo sapiens; identical to SEQ ID NO: 94261
  chr5:76011174-76011754
  Hyper

SEQ ID NO: 124671 - DNA, 35 bp, Homo sapiens; identical to SEQ ID NO: 94262
  chr5:76012164-76012199
  Hyper

SEQ ID NO: 124672 - DNA, 41 bp, Homo sapiens; identical to SEQ ID NO: 94263
  chr5:76012602-76012643
  Hyper

SEQ ID NO: 124673 - DNA, 30 bp, Homo sapiens; identical to SEQ ID NO: 94264
  chr5:76114850-76114880
  Hyper

SEQ ID NO: 124674 - DNA, 63 bp, Homo sapiens; identical to SEQ ID NO: 94265
  chr5:76115162-76115225
  Hyper

SEQ ID NO: 124675 - DNA, 166 bp, Homo sapiens; identical to SEQ ID NO: 94266
  chr5:76115443-76115609
  Hyper

SEQ ID NO: 124676 - DNA, 871 bp, Homo sapiens
  chr5:76249279-76250150
  Hyper
ccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggaggcgcgccaggagcgggagagggtggcgcgcccggggcgcaggaacccagcgcagcctaggctggaagtcggggcgctgggcactacagagcccgggaatggggcgcgcggagagcggccgcccgaggacggcgctgcggcggctgcagcccgggacttattgccccatgccctcctcccccagggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtggcacttcttagacacttcgctggtgcccgagt

SEQ ID NO: 124677 - DNA, 236 bp, Homo sapiens; identical to SEQ ID NO: 94270
  chr5:76250409-76250645
  Hyper

SEQ ID NO: 124678 - DNA, 30 bp, Homo sapiens; identical to SEQ ID NO: 40561
  chr5:76327167-76327197
  Hypo

SEQ ID NO: 124679 - DNA, 26 bp, Homo sapiens
  chr5:76327430-76327456
  Hypo
aaccttggctggacgcggtagctcac

SEQ ID NO: 124680 - DNA, 25 bp, Homo sapiens
  chr5:76327696-76327721
  Hypo
ccagccagggcgacagagtgcaact

SEQ ID NO: 124681 - DNA, 30 bp, Homo sapiens; identical to SEQ ID NO: 94274
  chr5:76475962-76475992
  Hyper

SEQ ID NO: 124682 - DNA, 556 bp, Homo sapiens; identical to SEQ ID NO: 94275
  chr5:76476235-76476791
  Hyper

SEQ ID NO: 124683 - DNA, 1057 bp, Homo sapiens
  chr5:76506145-76507202
  Hyper
gccgagccgcgggcacgctctgccctgtcgggagagctccgggagcggcgggaggggcggaggggcgcagtggggcccgggcggctgcggccgcggagccggggcacctgaggaggaaggagggtgggagcgagggagggaggggacgggcgcagaccgaaagtggggaaagaaggtgcaggcaggcgggcaggcgggcgggcgccctggcccagggccgcgggtgcgggagcccggcgaggtcgagctgggcggcggcgggggccgcgccgagggaggaggggaaggcggaggcgcggggagcgtgtttggggcgccgcggcggggagggtggcggccgctggtgcgcgcggggcgctgtgtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgtccgccccgtcggcggggctcgcacgggtagggggctccggcggagttgggtgaccgtgaggcggttggtttggaga

SEQ ID NO: 124684 - DNA, 30 bp, Homo sapiens; identical to SEQ ID NO: 94278
  chr5:76507421-76507451
  Hyper

SEQ ID NO: 124685 - DNA, 801 bp, Homo sapiens
  chr5:76923679-76924480
  Hyper
ggaagcctgtgatatcgatttgcctccaagtttaaaacacaccgcaaaccttcccctcggccgaccgaagaaacggcatttttttcctactcctttggggcagtcccctgagcacgtgcctgaagtcgaggttagtacgcagccagcagggaccctgacaggaaaccagagcagccccggggttgggggagccctggtaggtgctggtcgtcccggacacgcctcttctggagaagcgcgtttgtcccttacttgggaggtcccgggtatctgaagcggatcccgggtctggggacatgaaggggcgccgtggccttagggaaggccccaaagaggcctaggccccggaggaggcaagagccgcggcctagcttccaccgcgtacctggggccagacacggctggggcggcgccggagagcagaactccaggctctgaaggccgagggtgcgaattgtggtcccctcccacccacggcctccccatcacgcgcacgcagcccgcgaggggcgccctccgcgccactgccccagggacaccgttcatctgaggaactctcgcgccctgcgtttcgtgccgacagcgacgctcggagtcccacctgggaaacctgggttggcccggaaacctcgggaggctcagagcttgcgtgaggcgctcgcggcgccccagcatgccgccccgtcgcggagacctcaccttgcagcccagaaaccgaacccaagcccactgcagggcgaagggcccacgcgttccaactggcgcgaatataaccattcccaagaccggcccctcccctcc

SEQ ID NO: 124686 - DNA, 167 bp, Homo sapiens; identical to SEQ ID NO: 29701
  chr5:76924754-76924921
  Hyper

SEQ ID NO: 124687 - DNA, 1402 bp, Homo sapiens; identical to SEQ ID NO: 94283
  chr5:76925454-76926856
  Hyper

SEQ ID NO: 124688 - DNA, 783 bp, Homo sapiens; identical to SEQ ID NO: 94284
  chr5:76928157-76928940
  Hyper

SEQ ID NO: 124689 - DNA, 30 bp, Homo sapiens; identical to SEQ ID NO: 94285
  chr5:76929223-76929253
  Hyper

SEQ ID NO: 124690 - DNA, 1237 bp, Homo sapiens
  chr5:76932282-76933519
  Hyper
tatttgtcaataatgcgagcaggagttgaggtgtgcgctcggctgggccgcccgggggggcgctgaggttgccttctcaggcggaggaggcgaaccctgtagcccgacaacgccgggcttcgattttgaggagcttcttccgggatgtcgctatactggccggagacgggccttgcgtgtccattgggggatggcgatggggaccagtttccgggtagagaaggagataactcgatacaggaacgcacaggcagcctgaaagcagcccaggatctcgacaggggaagggaagaccctgctccctttgcccaaatcctcccgccctgtccttgccttctgtcccagatcccaagcccctcgtacctgcactcgggactcggtcagcccgatacgcagtgccagctcctcacgcataaagatgtcggggtagtgagtcttggcgaagctcctctccaactcgttgagctgtgcgggggtgaagcgcgtccggtggcgcttctgcttctgttggccctgctgctggccggcttggctggggttcgggccgccctggggcccgggctgcttgtccgggtctttggcgctcaccgccagcgaggccggagtagagcccactgtggtgatgtcctccccgggcagcagagtggctccctccactgggtcagagttgggcgccaggtcccccggatggcccccggggtcggagccccccacgcccagcctacacttcaccgcctcccggtggcccagaagctcggcggcatctttcatacctgaggaggcaaggggatcgcggtcactactttcttggcgatgccaggaggggctgtcttccccgcgcagccttccttcaacccgtcctcggccccctccgcacccgcgcttgtcctaaggaagaaactcccagggtattcagctgggttccccagaatttggacagccgggttggaataatatctcccggccccttgccctcgccgcagccggctcccgtagtaaacagcacaagctttcgtctctcccacaataaaacactcccagtcccggcaataaaacatgcctctgaatcccttccataaaccgtaccccaggcgccccaggaaatcgagagcaaatctttggacacaggggtgcggggggcagaaagaaaattaaacaattcctcggttgctgcggcacctgcgcttcggcagcctgacgaactgtacctccggccctcagccgattccctcttact

SEQ ID NO: 124691 - DNA, 30 bp, Homo sapiens; identical to SEQ ID NO: 94288
  chr5:76933770-76933800
  Hyper

SEQ ID NO: 124692 - DNA, 1258 bp, Homo sapiens
  chr5:76934040-76935298
  Hyper
cctaacaaattatcacggggtatatcgcctttcgaaaaaaaaaaaaaggcgggggaggggggaagagaaaaataagaaaaacaaaaagtaacaacattccccaactcctttcttggatctacatattccatagatttttttttaaaggcgatgttaaatcaaattaaactttaatgcagcacaattacttttaaagaaattagtccatttaggtcgcattaaggtaaaataaggaacaaattgacaatttcctgccccggcttctcctggctgcccgggcgagaggcgcgcactcacctagcctggcgtccaggaggtcggcatgagacagcatcgcgcaccgctccagggcgaaagctgttcccccccaaattttagcggctttaagttatttaaaatagatataagctataagctatacgatatagatatatatagatcacctaaatgaaagaaaattcggtttgtggttaaaaagggggcttcttgcattataatgtcctttagagagacggggaggtgcttaacagttgaatgaacccgtgagcagctcggcgaggggaccaatcaggagggcagcctgcaaatgtcagcgcccggagagtcccccactccgcccgcccgctcgcctgcgcccgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcctctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcggccttcagacaacgcctggacttcgccgcggctcagtaggcctgcgcctagggtccaggcgccctggctgtgccctggggtctatacgagccccaaccccacagtgggcctagagcgcaaagaggagtcggcttccctggcaccgccagcgcccgctgtctgctttggggaccctcgcggagtgtgggttcgagcgctctgcactcttctcaccgggcttcttcccggctcctgctcttccgcttggcccacgcccgcatcctcgcccctaactcgct

SEQ ID NO: 124693 - DNA, 799 bp, Homo sapiens; identical to SEQ ID NO: 94291
  chr5:76936016-76936815
  Hyper

SEQ ID NO: 124694 - DNA, 49 bp, Homo sapiens
  chr5:76937397-76937446
  Hyper
gctcccccctgctcccggttccctctcggtagctcgttttggccaatgt

SEQ ID NO: 124695 - DNA, 30 bp, Homo sapiens; identical to SEQ ID NO: 94293
  chr5:76938430-76938460
  Hyper

SEQ ID NO: 124696 - DNA, 393 bp, Homo sapiens
  chr5:76939420-76939813
  Hyper
caggatccccagcctcggagccaaatgccaagcaacgttcaggatccacacttggggctttctttctgttttttaaacgccggtagcaggctgcgtgtgcatgacacgtgtacttgtgtgtgcttgtgcgagcagtgcgtgttccttgcctgttcactcacacggagggggcatgccaggcgctgcggaggggcagaaacctgccccaaagagtctcatttcctatcccacccagaagcctttcgcaatacacgagctcgacatatacacttttttcttttctgcagtaaacagtttcccacacattcgagtttgcaaacttcaaccagacagtccacccgcctgacttttcgtgggtgcaagggccggtcccttgctcgttttttctcccat

SEQ ID NO: 124697 - DNA, 151 bp, Homo sapiens; identical to SEQ ID NO: 94295
  chr5:76940344-76940495
  Hyper

SEQ ID NO: 124698 - DNA, 1044 bp, Homo sapiens
  chr5:76940857-76941901
  Hyper
ccctcgtcccctccccgcaacccgagtgcggctaattccgggcgtctatattcactcaattagagaaatctacagagaagatcgatcttccatctgcagacatgccagcttaacaaattagattcttgtttcgtgcaggtgatttggtgacagttggggaattagaagtaataagttgttgtgtttgagcccgggcccccgccccccgcccgcgcccctccccgcccgggggcccctcggccgcgcccgccgcccgggcaccccctaccgcaccccccagccggcccgcgccgccgccgccgtcgccgcatcccccgccgtaattagtgctgctgccctccatgtgggctcgattaaaccgtgatttagccgaaagaaatataattatggctgcaaataaaataatcagcattgaagagcgatttccttaatgagatggagcggttgcacgtcacggagtaaaggggtctcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccagggggcgcagcgcccgcagcgcggcctcctcccggcgtctcccgcgccgtcgggccgggcgggggacacaagccgccgcagcggctagggggccccgccagcccggcccgctccgcctcggctgggcggccgggttggcacaagcaactgccaggcccccgaacactggagaagccggcccgagggaggggcccttgcctggggcgggtgccgagggtcagtccaggaaacttctggaacaggtggaagtcctcccgggtagatgtgagctccatcgggaaaagggtgtcacaaaaacaggtgctcagaggcaggggtgccaccgcggcaccccagaaccccgggtcagctcgcgcggacaccgcgtctgggagtcctggcgtggaagggcctcgggggttctcattc

SEQ ID NO: 124699 - DNA, 23 bp, Homo sapiens
  chr5:77047288-77047311
  Hypo
caccgcgccggccagcctgacca

SEQ ID NO: 124700 - DNA, 244 bp, Homo sapiens; identical to SEQ ID NO: 94299
  chr5:77140527-77140771
  Hyper

SEQ ID NO: 124701 - DNA, 616 bp, Homo sapiens
  chr5:77147516-77148132
  Hyper
cggcgtgcatgtgtgcgtgtgtgcacgcgcgagaagtgcgtgtgtaggcgcgtgtgcaagtgcgcgcgcgtgtgtttacacttccagaagtcaaatcctttctaggactcccccttgcttcacccggaagtgttcggtgacccctccacccaattaatgaaaacaaagcaaagggcccgagcgggcctccgacagcccggggcttgcggagctggacgccgacagggcgtcagcccggtcgctcgcggcgcggaggctgctgcggttcggagctggggttctgcactctcgctcccggctcccggctcccggctccccgccacccgcagcctcctcgcgccgccgccgcgggcaccgccggggcttcagtgacaccaggcacccgccccgggccgcgggaggaggaaattccctgcaaaatagcaatggttccgagaaaaggatcacaacaaaatattgaataaattcccttttaatttatttgatcattccacattacggggctatgaattgctcaaatttgataacaagtactcaattcaactcattatgtaagttaaattagacttcgataaaatttcagtggcgcgcagtggttcctcgaatgaaatgtaat

SEQ ID NO: 124702 - DNA, 283 bp, Homo sapiens; identical to SEQ ID NO: 94302
  chr5:77148386-77148669
  Hyper

SEQ ID NO: 124703 - DNA, 135 bp, Homo sapiens
  chr5:77253883-77254018
  Hyper
ggagcgggaggctctcggcccgccgctcgcgggaacccccacctcgggcggccgggagggcagttggtggcggcgtggcctctttgtccccgtcagcccgaggcggcgctggtgcccacccggcctccccgtggc

SEQ ID NO: 124704 - DNA, 1080 bp, Homo sapiens
  chr5:77268367-77269447
  Hyper
gctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccgcagcctgggctggggatccggcacctgggcagggtgagcttggccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgcggcccccggggaccgcgagcaacaaaagcccggcccgcagcccctgctcctcgccttccttttcaattctcccctgatctcaggtggaattaggaggattaaagcagcaagtaaatgaggcgagtgtgcaaaatgactcctttctgaaccaaacggcatgctccgtgctggggaaatgagatgcacatttaaatctcatccatccaccgcctgcggccaccgccatgtacctgcctacttagcccaagggttaattaattgaggcttcaatgcactattgcaagagcattattgcatttgatactctacatctgtgatttaaaactctttcagtcccttgtcagcaagggagggtttttaactaggaaattagcattcagataagggaacgctctatttgcttctgaaaggaaggaaatattaaggatgctggtgcacaaaccgggctgtcatatcctgtcccatcctggagggagcgcgagggcccggctcctctgggagtggcggcgacagggcgtcgtgcaatggacgccagcaccaggggcgggctggagggggaccggcgatcagggaaaccttactcctcgcaggcttcaacctgctggggcgtgtttacgtccgcaaagtccgataatatattttgtccccacttcttaggagctgattcttcttaaaatgcattgccacgttatctctaacgttggctttctgac

SEQ ID NO: 124705 - DNA, 90 bp, Homo sapiens; identical to SEQ ID NO: 94308
  chr5:77655493-77655583
  Hypo

SEQ ID NO: 124706 - DNA, 97 bp, Homo sapiens
  chr5:77806223-77806320
  Hyper
aggggagagggagggcggttagcagcgccgccaggccccgccccgccttcccgccgcgcagcgacaccgtccaagtccggcccgtgcccgcagaacc

SEQ ID NO: 124707 - DNA, 30 bp, Homo sapiens; identical to SEQ ID NO: 94310
  chr5:77943372-77943402
  Hyper

SEQ ID NO: 124708 - DNA, 106 bp, Homo sapiens; identical to SEQ ID NO: 94311
  chr5:78105439-78105545
  Hypo

SEQ ID NO: 124709 - DNA, 878 bp, Homo sapiens
  chr5:78407583-78408461
  Hyper
ccccacgcccaactgcgggtataaagaggcaggctgcggactcggagcagctcggggctgcgcagcgggaaggctcgcctagtcggtccgcatccgtgtcgaccacctgtctggacaccacgaagatgccacccgttgggggcaaaaaggccaagaaggtgagtctccaggggacccgagggcgctctccttcccctcccacctgctctgtatcccagcctctgggagcgcagaggggccctcggaccctgcctggtacccatcatcctcctactccctcccctccctcagcctcagaccagaatgtgcttccagaacttctccagcaggaccccaaggcgcctctgagcctccccactcctgccccacgttcagagcgcgcccccagagcgcctctgtcccctccagccccagcccagcttggaccagagtgcgccccagatctatgtgatccttgcctctcagacccaaaggcaccctctgagccctccctgacggctgggtgtccccagaactccgagccttccaatatcttctgaatctggcaccccaagaccagaaaactccctagagatactgctcctagccccgcaggcgcgatatcccgtccccacggagcccctccgcatctgtgtccgaggccgccgcgagcgccctctgcacccggcgcgcccagaacagggaggagtgcacggcgctggctccgacatttcccgcctggatctgcaccgcgggtgtcggggccgcctccccgccgggttctcgctgcacccaaggcccaggcgctggttgggtgattgcagattttcacaggcaatttgatgtccgtgatgacagaaaaatgtcatccgaaatgtcagcctcgaaaacatggttta

SEQ ID NO: 124710 - DNA, 20 bp, Homo sapiens
  chr5:78469259-78469279
  Hypo
agtatttttctatttcgaaa

SEQ ID NO: 124711 - DNA, 30 bp, Homo sapiens; identical to SEQ ID NO: 94319
  chr5:78533526-78533556
  Hyper

SEQ ID NO: 124712 - DNA, 115 bp, Homo sapiens; identical to SEQ ID NO: 40564
  chr5:78552615-78552730
  Hypo

SEQ ID NO: 124713 - DNA, 35 bp, Homo sapiens; identical to SEQ ID NO: 40565
  chr5:78881941-78881976
  Hypo

SEQ ID NO: 124714 - DNA, 165 bp, Homo sapiens; identical to SEQ ID NO: 94322
  chr5:78985096-78985261
  Hypo

SEQ ID NO: 124715 - DNA, 566 bp, Homo sapiens
  chr5:79330913-79331479
  Hyper
ctttctctccagccccgactgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggccgcaccataaagcgcccggccgctgccgcggagcccagcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccagggtaagtgggttcgggtcgggcctgggagcgc

SEQ ID NO: 124716 - DNA, 30 bp, Homo sapiens; identical to SEQ ID NO: 94328
  chr5:79550635-79550665
  Hyper

SEQ ID NO: 124717 - DNA, 34 bp, Homo sapiens; identical to SEQ ID NO: 94329
  chr5:79554316-79554350
  Hypo

SEQ ID NO: 124718 - DNA, 16 bp, Homo sapiens
  chr5:79783240-79783256
  Hypo
acagtctagctctatc

SEQ ID NO: 124719 - DNA, 30 bp, Homo sapiens; identical to SEQ ID NO: 94331
  chr5:79784399-79784429
  Hyper

SEQ ID NO: 124720 - DNA, 835 bp, Homo sapiens
  chr5:79864827-79865662
  Hyper
tgaggatgctggcagcgtctccacggtccccgccgacccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctccgacccgcgcgctcttgcggcccagcgcgcgccgctcccgctgctgcgccgaccttcgcccatcaggccccccgccccgcatcctcctcgacaccccgcggccgggcagccctcgccggttcccgccgctcggcgaggctgagaaggaggcggaacccgcatccccgcggagtccaagccccagcggccgcaaaactggaaccgagaaccagtggga

SEQ ID NO: 124721 - DNA, 619 bp, Homo sapiens
  chr5:79865891-79866510
  Hyper
tcgatgtcctcctcccggcagccgccactgcaagccaaagtttcccaagtgcagccggcagggacggcgcctcacactgacctgggacgcgctgtcgagttggcggcggcgctttcaaacctctctccggcactgcccgaccctctgtgcggccctagggcgccgtctgagctgagctgtggtcttcggctcctcggcgcctcgaatcgcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctccccattgagggaagcacgcacccctacgtcacgggctttggctcctccagtccgtatccctcccctcagctcacatccacccgctggttcatgggt

SEQ ID NO: 124722 - DNA, 169 bp, Homo sapiens; identical to SEQ ID NO: 94335
  chr5:79911156-79911325
  Hypo

SEQ ID NO: 124723 - DNA, 302 bp, Homo sapiens; identical to SEQ ID NO: 94336
  chr5:79947482-79947784
  Hypo

SEQ ID NO: 124724 - DNA, 815 bp, Homo sapiens
  chr5:80255751-80256566
  Hyper
tgtcatgagtgtgtgcgcgtgtgtttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgccggcgccgcgccgactttgccctttaaatcggtctccaagccgattacagctgagctcccacgtgacgttttaccttctgtctcccggagcgcgttgcccgaggacagtccttccccggctgccgccccagcccgccgcgggggctcggctcccgcaactttgggcgaagcggcggccggctcgggcgccctcgcggggccgcgctccacgcgggcgttgggggcttggggggctccgggggctcggccgggagggtggtggttagggcggagagcgtgcctcggccccagcccgcgcccctgccaccgcgcgccgcggcctcccgaaagcgggcggggtgccctgcgcgcggcgtggggaaagggggcgcccttcgccggccgggacctgagcggtcgcgccctcgagggagccagctgggccatggccgcgaggcaggggtgagaccggcggccacccgtgagccctccgcacccgcaccatgcagaag

SEQ ID NO: 124725 - DNA, 207 bp, Homo sapiens
  chr5:80256790-80256997
  Hyper
gccacccagggccggcgccgggcagggaggcgtccgagacgcgctggacaagcaggtaccgcgcgccttctctccgcggtctcccagccttgatcgccgcactcccttgccgtcctaatccggggatcaggggtcgggggtcgtgaaagagtgcggggactatgctccgaaatccccccgcgtcaccagtggcgggacatctccacg

SEQ ID NO: 124726 - DNA, 591 bp, Homo sapiens
  chr5:80689592-80690183
  Hyper
ggaatgaaggagtcccgagagccacacatttgggaaccaccggtctcggccatgcccagcgcgggcgcactgttgcaacacccctatccctggctgcgcagggttcagctctccgcaagtaccttcctcgccttcctaccccccccagcccccagccgccgccgctcccgcagccccggtcccgcgcctccccgcagccccggcgcccgcctacccgccaggcaggcggtggtgtcgatccacttgagcagctgccccgcgctcagctcgccgcgcgcagtggcgtgcgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaagtctgggaagtgcgcggggagggggctcc

SEQ ID NO: 124727 - DNA, 26 bp, Homo sapiens
  chr5:80887672-80887698
  Hypo
aggagccaagatggccgaataggaac

SEQ ID NO: 124728 - DNA, 143 bp, Homo sapiens; identical to SEQ ID NO: 94345
  chr5:80895313-80895456
  Hypo

SEQ ID NO: 124729 - DNA, 89 bp, Homo sapiens; identical to SEQ ID NO: 94346
  chr5:81075041-81075130
  Hyper

SEQ ID NO: 124730 - DNA, 103 bp, Homo sapiens; identical to SEQ ID NO: 94347
  chr5:81266149-81266252
  Hypo

SEQ ID NO: 124731 - DNA, 38 bp, Homo sapiens; identical to SEQ ID NO: 94348
  chr5:81266652-81266690
  Hypo

SEQ ID NO: 124732 - DNA, 21 bp, Homo sapiens
  chr5:81575044-81575065
  Hypo
ccaccgcgcctggccatttaa

SEQ ID NO: 124733 - DNA, 784 bp, Homo sapiens; identical to SEQ ID NO: 94351
  chr5:82767026-82767810
  Hyper

SEQ ID NO: 124734 - DNA, 1152 bp, Homo sapiens; identical to SEQ ID NO: 29742
  chr5:82768217-82769369
  Hyper

SEQ ID NO: 124735 - DNA, 408 bp, Homo sapiens; identical to SEQ ID NO: 94353
  chr5:82769910-82770318
  Hyper

SEQ ID NO: 124736 - DNA, 49 bp, Homo sapiens; identical to SEQ ID NO: 94354
  chr5:82770563-82770612
  Hyper

SEQ ID NO: 124737 - DNA, 172 bp, Homo sapiens; identical to SEQ ID NO: 94355
  chr5:83017828-83018000
  Hyper

SEQ ID NO: 124738 - DNA, 30 bp, Homo sapiens; identical to SEQ ID NO: 94356
  chr5:83527381-83527411
  Hypo

SEQ ID NO: 124739 - DNA, 94 bp, Homo sapiens; identical to SEQ ID NO: 94357
  chr5:83678217-83678311
  Hyper

SEQ ID NO: 124740 - DNA, 265 bp, Homo sapiens; identical to SEQ ID NO: 94358
  chr5:83678989-83679254
  Hyper

SEQ ID NO: 124741 - DNA, 800 bp, Homo sapiens
  chr5:83679569-83680369
  Hyper
cctctccacctcacccgcggccaaaacgcccagcgccgggtctgggtttgcgaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgacta

SEQ ID NO: 124742 - DNA, 80 bp, Homo sapiens
  chr5:83680671-83680751
  Hyper
gtgtacaaacagaggcggcgtgcgtgtgagtctgagcctggcaggcgcgctccccactcccccggcgcccgcccgccctc

SEQ ID NO: 124743 - DNA, 30 bp, Homo sapiens; identical to SEQ ID NO: 94362
  chr5:84126401-84126431
  Hypo

SEQ ID NO: 124744 - DNA, 32 bp, Homo sapiens; identical to SEQ ID NO: 94364
  chr5:86308932-86308964
  Hypo

SEQ ID NO: 124745 - DNA, 30 bp, Homo sapiens; identical to SEQ ID NO: 94365
  chr5:86795866-86795896
  Hypo

SEQ ID NO: 124746 - DNA, 225 bp, Homo sapiens; identical to SEQ ID NO: 94366
  chr5:86837505-86837730
  Hypo

SEQ ID NO: 124747 - DNA, 175 bp, Homo sapiens; identical to SEQ ID NO: 94367
  chr5:87436594-87436769
  Hyper

SEQ ID NO: 124748 - DNA, 30 bp, Homo sapiens; identical to SEQ ID NO: 29749
  chr5:87955350-87955380
  Hyper

SEQ ID NO: 124749 - DNA, 338 bp, Homo sapiens
  chr5:87955602-87955940
  Hyper
ttggccagtgcccttcggtgtcactgaagctcagcccgcggacggcggtgtgtcagtgtgcaccgggaggcctgggcctcagtccctgggctcgtgcctacgcaacagcaggaccgcccgcggcctcccaggaccagtgaccgtcacccgcagtaaggatcggggcggctccgccagtttcggccctctttccaagacctctttccaaggcgctctttcctagcctcacccgagggccgcagagccggacctgtgccgggcgagttggatttagcccagttagagttaagatggtatcattagctgcgcacagcgtgacttcccgctaatcctctctg

SEQ ID NO: 124750 - DNA, 1042 bp, Homo sapiens
  chr5:87956158-87957200
  Hyper
gcccagagtggcaagcgctcaccaacgccggccaccgagcaaaacttccccgcccccgccccccacccagcttccccgcagggagaccctttccgttagcagcttttcactaagttaataacggtgtgtgtgtggtggtggcggggaggggggatttgggggttacacaatatctatatcaatgatattgatcacgtccagggaagaagcctgggcaaaactagagacaccgagtgtcagcaaaagaaagcttcttaaccacaagttgcgtgccgcctgaggaaggtgccctgtggcagggggtggccgctgggagatgcctgcctctaaccgacgtccaggcgtgactaaacctcgacgccacccccattcacaagctcaactcagggattcccaagcaaccgcagaccggaggtggcgcagaggcagtgaccgaggtcgctgattaggggccgagaggctggcaaataataattttaaaaaaaaaaaaaaccggaatagccttcgcggacgcagctcagcgtgccaggcaaaggacagtctgacgacccgcccctgccgagccccgcagcgcggcgccggtgtccagcagcctccaaggcgccgagcgcgggcacgggaacttgagctagcgcaaacttgggcggcctcccagcctgctacccgggccgcagcgcgcccccggcctcccagtcgcgcgccaacccgggagcgcgcgcgccggcgcaccagctccatcagctagaggagcccgtctcccgggaaacaccaatcagacgcccgctttcaggcgagggccgcgagccgcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaacc

SEQ ID NO: 124751 - DNA, 287 bp, Homo sapiens; identical to SEQ ID NO: 94373
  chr5:87961738-87962025
  Hyper

SEQ ID NO: 124752 - DNA, 302 bp, Homo sapiens; identical to SEQ ID NO: 94374
  chr5:87962615-87962917
  Hyper

SEQ ID NO: 124753 - DNA, 55 bp, Homo sapiens; identical to SEQ ID NO: 29755
  chr5:87963456-87963511
  Hyper

SEQ ID NO: 124754 - DNA, 506 bp, Homo sapiens
  chr5:87967713-87968219
  Hyper
agcgccctaattaccggtgccaaggtggagaaaggagggtggtagacagaggtggacaccaagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagctccgtttggataccagaagcgtcttaagctgaaccgctccaagtaccaataactaaccatgatggttgcatcttgatgaatctgaacttgggataaccctgtaaagcggcctctcacctcc

SEQ ID NO: 124755 - DNA, 503 bp, Homo sapiens
  chr5:87968488-87968991
  Hyper
ttcccttttccaacgcgaagatttcctggcatctctctgcgattgggggtcaagccgctggataattaacagtactggctaagaaaactcacgagatcaacaggtttaacatccgaggcacacaatcaattagctgaagcaaagccccggactggccctcggagcggcccgcagcgggactctgcgggcaccggctagcgggcgaggtgaggagtgcgggcgcggggccgcggcgggcactgctggcctcgcgccgcgggcgagctgcagcctgagggccgccacgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaaaaaaaaaaatgtttttctcatcattcctctcccctgctcaacacatttaaaactgccgctcaattccacat

SEQ ID NO: 124756 - DNA, 877 bp, Homo sapiens
  chr5:87970041-87970918
  Hyper
gaagggtgggggcttcgaggggaaggtgggcttcctgcaacacaagcggagaggctgtcaggggtgtgggcacgggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggctacagaatggc

SEQ ID NO: 124757 - DNA, 624 bp, Homo sapiens; identical to SEQ ID NO: 94381
  chr5:87971517-87972141
  Hyper

SEQ ID NO: 124758 - DNA, 30 bp, Homo sapiens; identical to SEQ ID NO: 94382
  chr5:87973581-87973611
  Hyper

SEQ ID NO: 124759 - DNA, 1076 bp, Homo sapiens; identical to SEQ ID NO: 94383
  chr5:87973988-87975064
  Hyper

SEQ ID NO: 124760 - DNA, 461 bp, Homo sapiens; identical to SEQ ID NO: 94384
  chr5:87976202-87976663
  Hyper

SEQ ID NO: 124761 - DNA, 87 bp, Homo sapiens; identical to SEQ ID NO: 94385
  chr5:87979692-87979779
  Hyper

SEQ ID NO: 124762 - DNA, 86 bp, Homo sapiens; identical to SEQ ID NO: 94386
  chr5:87979899-87979985
  Hyper

SEQ ID NO: 124763 - DNA, 164 bp, Homo sapiens; identical to SEQ ID NO: 94387
  chr5:87980397-87980561
  Hyper

SEQ ID NO: 124764 - DNA, 704 bp, Homo sapiens; identical to SEQ ID NO: 94388
  chr5:87980621-87981325
  Hyper

SEQ ID NO: 124765 - DNA, 30 bp, Homo sapiens; identical to SEQ ID NO: 29769
  chr5:87983365-87983395
  Hyper

SEQ ID NO: 124766 - DNA, 30 bp, Homo sapiens; identical to SEQ ID NO: 29770
  chr5:87984984-87985014
  Hyper

SEQ ID NO: 124767 - DNA, 293 bp, Homo sapiens; identical to SEQ ID NO: 94391
  chr5:87985348-87985641
  Hyper

SEQ ID NO: 124768 - DNA, 157 bp, Homo sapiens; identical to SEQ ID NO: 94392
  chr5:87985895-87986052
  Hyper

SEQ ID NO: 124769 - DNA, 83 bp, Homo sapiens; identical to SEQ ID NO: 94393
  chr5:87986310-87986393
  Hyper

SEQ ID NO: 124770 - DNA, 30 bp, Homo sapiens; identical to SEQ ID NO: 94394
  chr5:87987135-87987165
  Hyper

SEQ ID NO: 124771 - DNA, 499 bp, Homo sapiens; identical to SEQ ID NO: 94395
  chr5:87988152-87988651
  Hyper

SEQ ID NO: 124772 - DNA, 144 bp, Homo sapiens; identical to SEQ ID NO: 94396
  chr5:87990308-87990452
  Hyper

SEQ ID NO: 124773 - DNA, 30 bp, Homo sapiens; identical to SEQ ID NO: 94397
  chr5:87991044-87991074
  Hyper

SEQ ID NO: 124774 - DNA, 30 bp, Homo sapiens; identical to SEQ ID NO: 29777
  chr5:87991432-87991462
  Hyper

SEQ ID NO: 124775 - DNA, 30 bp, Homo sapiens; identical to SEQ ID NO: 94399
  chr5:88015167-88015197
  Hypo

SEQ ID NO: 124776 - DNA, 259 bp, Homo sapiens; identical to SEQ ID NO: 94400
  chr5:88178852-88179111
  Hyper

SEQ ID NO: 124777 - DNA, 258 bp, Homo sapiens; identical to SEQ ID NO: 94401
  chr5:88179171-88179429
  Hyper

SEQ ID NO: 124778 - DNA, 495 bp, Homo sapiens; identical to SEQ ID NO: 94402
  chr5:88179851-88180346
  Hyper

SEQ ID NO: 124779 - DNA, 1148 bp, Homo sapiens
  chr5:88184853-88186001
  Hyper
taaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgcgacgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttg

SEQ ID NO: 124780 - DNA, 26 bp, Homo sapiens
  chr5:88371468-88371494
  Hypo
aatcttgcttaggggcggatctcctg

SEQ ID NO: 124781 - DNA, 32 bp, Homo sapiens; identical to SEQ ID NO: 94406
  chr5:88391487-88391519
  Hypo

SEQ ID NO: 124782 - DNA, 30 bp, Homo sapiens; identical to SEQ ID NO: 94407
  chr5:88427549-88427579
  Hypo

SEQ ID NO: 124783 - DNA, 30 bp, Homo sapiens; identical to SEQ ID NO: 94408
  chr5:89073758-89073788
  Hypo

SEQ ID NO: 124784 - DNA, 26 bp, Homo sapiens
  chr5:89504166-89504192
  Hypo
tggcagaataggaaccgctccaatct

SEQ ID NO: 124785 - DNA, 30 bp, Homo sapiens; identical to SEQ ID NO: 94411
  chr5:89854111-89854141
  Hyper

SEQ ID NO: 124786 - DNA, 446 bp, Homo sapiens; identical to SEQ ID NO: 29782
  chr5:89854523-89854969
  Hyper

SEQ ID NO: 124787 - DNA, 37 bp, Homo sapiens; identical to SEQ ID NO: 94417
  chr5:92906137-92906174
  Hyper

SEQ ID NO: 124788 - DNA, 196 bp, Homo sapiens
  chr5:92906518-92906714
  Hyper
ccgcgcgcaaggctccgcggccggatatgggcctagcttccgggatccgctccctgcggggccgcgcttagggtcggagttcgctagtccagggaaaggggtgggaggggccctcggaggggcccctacaagggatcccagtccgcagaattaaaaattcgttcgcaagggagcgcccttccggggtcagggtcgt

SEQ ID NO: 124789 - DNA, 86 bp, Homo sapiens
  chr5:92915042-92915128
  Hyper
ccttccggaggagcccgcggcttcgcctgaggcctcgcgggcccaacttctccccaccgctagggtcacgccgggtcccaggggcc

SEQ ID NO: 124790 - DNA, 150 bp, Homo sapiens; identical to SEQ ID NO: 94420
  chr5:92915445-92915595
  Hyper

SEQ ID NO: 124791 - DNA, 328 bp, Homo sapiens; identical to SEQ ID NO: 29785
  chr5:92915837-92916165
  Hyper

SEQ ID NO: 124792 - DNA, 30 bp, Homo sapiens; identical to SEQ ID NO: 94422
  chr5:92921022-92921052
  Hyper

SEQ ID NO: 124793 - DNA, 427 bp, Homo sapiens
  chr5:92939780-92940207
  Hyper
ggtgtttgggggctgcgtggtgagccgaggcaaagccagggtaccccgatcgtcttccgggcgcatccaccatgcggcaccgccccagccacggcggccgcgcgtggagacccgggggcttaacaaagggctccgcgggggcacgggggggcgcggccacgtgacaggcccgagcgcgacgtcgctgtccagccgcggggaggggcggccagcccggggggccgtggggcttcttgacatagaacgtccgggcctcgggctggccgcgccgggccgcgctccgccgggatgagaagtacttgtctggctccgcgctggagaagccgcacctctcatctctccggctcttacttgaaaaagcacttggaagaaactgtgtgtgcgctgggagggccgcggggtgggccggggccggctgcgaggctga

SEQ ID NO: 124794 - DNA, 30 bp, Homo sapiens
  chr5:92946622-92946652
  Hyper
ctagtctagaatattcgagtcttcaagtca

SEQ ID NO: 124795 - DNA, 43 bp, Homo sapiens; identical to SEQ ID NO: 94425
  chr5:92948358-92948401
  Hyper

SEQ ID NO: 124796 - DNA, 805 bp, Homo sapiens; identical to SEQ ID NO: 94427
  chr5:94620329-94621134
  Hyper

SEQ ID NO: 124797 - DNA, 1724 bp, Homo sapiens; identical to SEQ ID NO: 94429
  chr5:94955559-94957283
  Hyper

SEQ ID NO: 124798 - DNA, 90 bp, Homo sapiens; identical to SEQ ID NO: 40573
  chr5:94982142-94982232
  Hypo

SEQ ID NO: 124799 - DNA, 80 bp, Homo sapiens; identical to SEQ ID NO: 94431
  chr5:95067652-95067732
  Hyper

SEQ ID NO: 124800 - DNA, 21 bp, Homo sapiens
  chr5:95117541-95117562
  Hypo
agactccgtctcaaaaaaaga

SEQ ID NO: 124801 - DNA, 98 bp, Homo sapiens; identical to SEQ ID NO: 94436
  chr5:95551329-95551427
  Hypo

SEQ ID NO: 124802 - DNA, 30 bp, Homo sapiens; identical to SEQ ID NO: 94437
  chr5:95767930-95767960
  Hyper

SEQ ID NO: 124803 - DNA, 161 bp, Homo sapiens; identical to SEQ ID NO: 94438
  chr5:95768166-95768327
  Hyper

SEQ ID NO: 124804 - DNA, 200 bp, Homo sapiens; identical to SEQ ID NO: 94439
  chr5:95768893-95769093
  Hyper

SEQ ID NO: 124805 - DNA, 116 bp, Homo sapiens; identical to SEQ ID NO: 94440
  chr5:95769953-95770069
  Hyper

SEQ ID NO: 124806 - DNA, 43 bp, Homo sapiens; identical to SEQ ID NO: 94441
  chr5:96038372-96038415
  Hyper

SEQ ID NO: 124807 - DNA, 45 bp, Homo sapiens; identical to SEQ ID NO: 94442
  chr5:98104846-98104891
  Hyper

SEQ ID NO: 124808 - DNA, 110 bp, Homo sapiens; identical to SEQ ID NO: 94443
  chr5:98200994-98201104
  Hypo

SEQ ID NO: 124809 - DNA, 30 bp, Homo sapiens; identical to SEQ ID NO: 94444
  chr5:99383200-99383230
  Hypo

SEQ ID NO: 124810 - DNA, 150 bp, Homo sapiens; identical to SEQ ID NO: 94445
  chr5:99389805-99389955
  Hypo

SEQ ID NO: 124811 - DNA, 1730 bp, Homo sapiens; identical to SEQ ID NO: 92690
  chr5:100236150-100237880
  Hyper

SEQ ID NO: 124812 - DNA, 1441 bp, Homo sapiens
  chr5:100238283-100239724
  Hyper
tgacttctcctttggcgagagagcacccagggccaacacaactgtcaccacaaccacacagagcaagttgaactcatactgggaacagcttagagaagcacgcacatctcaacaacagcctttgttatttaattcatgacactaaccacgcgcaagctcaaacaaacacacatgctatcctaaccatcactctaccctctatattcacatttcatttatggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttcgggggcgtcactggcccttccctcttgctaggagataaacgctgcgcaaagccaatcaccaggctgagggggcggaggctgcttggagagtaacgtccccggctctgcctgctctgtgccgggagaggaagctcacagtgctacgcgcctgcgagctcgcgcacatacacatatacatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 124813 - DNA, 221 bp, Homo sapiens
  chr5:100240068-100240289
  Hyper
tgttggctggtaggtcgggaggcacctctagcatgagacagtgtctggaagccaggatttccctcatctatatgcgccggtccccagctccctggtcgccagggtttctctccagttgaattccgtgttccttcaggttgaacagtagcttcagcggtttttcacgctcagaaatgatgaggcccaattccaatcttccctcccgccggaagtaagaaggg

SEQ ID NO: 124814 - DNA, 208 bp, Homo sapiens; identical to SEQ ID NO: 92701
  chr5:101631427-101631635
  Hyper

SEQ ID NO: 124815 - DNA, 40 bp, Homo sapiens; identical to SEQ ID NO: 92702
  chr5:101632034-101632074
  Hyper

SEQ ID NO: 124816 - DNA, 35 bp, Homo sapiens; identical to SEQ ID NO: 92703
  chr5:102048048-102048083
  Hypo

SEQ ID NO: 124817 - DNA, 30 bp, Homo sapiens; identical to SEQ ID NO: 92704
  chr5:102090335-102090365
  Hyper

SEQ ID NO: 124818 - DNA, 514 bp, Homo sapiens; identical to SEQ ID NO: 92733
  chr5:107005171-107005685
  Hyper

SEQ ID NO: 124819 - DNA, 277 bp, Homo sapiens; identical to SEQ ID NO: 92734
  chr5:107005983-107006260
  Hyper

SEQ ID NO: 124820 - DNA, 718 bp, Homo sapiens; identical to SEQ ID NO: 92735
  chr5:107006709-107007427
  Hyper

SEQ ID NO: 124821 - DNA, 179 bp, Homo sapiens; identical to SEQ ID NO: 92737
  chr5:107840292-107840471
  Hypo

SEQ ID NO: 124822 - DNA, 197 bp, Homo sapiens; identical to SEQ ID NO: 92744
  chr5:110022402-110022599
  Hypo

SEQ ID NO: 124823 - DNA, 777 bp, Homo sapiens; identical to SEQ ID NO: 92745
  chr5:110408656-110409433
  Hyper

SEQ ID NO: 124824 - DNA, 1123 bp, Homo sapiens
  chr5:110559554-110560677
  Hyper
taggtgggagggactcgccacggagacgcgctcaaggagggatgagttgcgccaccaccacctaggtccctctctcgctatccggcggggccgcccggacccaggtgctgccagggtacgcctggcgcccgccatcccagagcagcgtcccgctgcgcacggtctccctccagctccggtccccgcgggagggcgcgtgggatgatgcgcgggtccttgtgccttccccaagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggtaaggcgcgggctccggctggggaagcccgcggcgtgcactgggggttgtccctctcgcagcgacggctcggagggtgcgggagcctgccttcgtgcccttcgatttctccctacctagttagtgtcttgagagagagctaaccttcattcaggtgcggctcgagtccttcccaccccaccagagcgcctaggccggtgcagctgtaggatcagcccgactccctcccaccttccctccttctcgcaggctgccacttcccttgggtgacagctcccaccgcacgtgggccctgctttcccaattgatatctttgctcacgattatagcttgcc

SEQ ID NO: 124825 - DNA, 18 bp, Homo sapiens
  chr5:110885341-110885359
  Hypo
agaagactgagaggccgg

SEQ ID NO: 124826 - DNA, 17 bp, Homo sapiens
  chr5:111306228-111306245
  Hypo
gaagtcttactgggtcg

SEQ ID NO: 124827 - DNA, 30 bp, Homo sapiens; identical to SEQ ID NO: 92751
  chr5:111602040-111602070
  Hypo

SEQ ID NO: 124828 - DNA, 30 bp, Homo sapiens; identical to SEQ ID NO: 92753
  chr5:111706271-111706301
  Hypo

SEQ ID NO: 124829 - DNA, 376 bp, Homo sapiens; identical to SEQ ID NO: 92754
  chr5:111754705-111755081
  Hyper

SEQ ID NO: 124830 - DNA, 128 bp, Homo sapiens; identical to SEQ ID NO: 40578
  chr5:111813766-111813894
  Hypo

SEQ ID NO: 124831 - DNA, 79 bp, Homo sapiens; identical to SEQ ID NO: 40579
  chr5:111875281-111875360
  Hypo

SEQ ID NO: 124832 - DNA, 31 bp, Homo sapiens; identical to SEQ ID NO: 92758
  chr5:111987787-111987818
  Hypo

SEQ ID NO: 124833 - DNA, 199 bp, Homo sapiens
  chr5:112043090-112043289
  Hyper
agcgaagcagtgcccggcaagcggagcgcagcacccattgcgcctgcgcataacaggctctagtctccgggctgtgggaagccagcaacacctctcacgcatgcgcattgtagtcttcccacctcccacaagatggcggagggcaagtagcaagggggcggggtgtggccgccggaagcctagccgctgctcggggggg

SEQ ID NO: 124834 - DNA, 74 bp, Homo sapiens; identical to SEQ ID NO: 92759
  chr5:112073410-112073484
  Hyper

SEQ ID NO: 124835 - DNA, 206 bp, Homo sapiens; identical to SEQ ID NO: 40581
  chr5:112198294-112198500
  Hypo

SEQ ID NO: 124836 - DNA, 78 bp, Homo sapiens; identical to SEQ ID NO: 92762
  chr5:112629200-112629278
  Hyper

SEQ ID NO: 124837 - DNA, 290 bp, Homo sapiens; identical to SEQ ID NO: 92763
  chr5:112629488-112629778
  Hyper

SEQ ID NO: 124838 - DNA, 451 bp, Homo sapiens; identical to SEQ ID NO: 92764
  chr5:112630247-112630698
  Hyper

SEQ ID NO: 124839 - DNA, 129 bp, Homo sapiens; identical to SEQ ID NO: 92765
  chr5:112823685-112823814
  Hyper

SEQ ID NO: 124840 - DNA, 251 bp, Homo sapiens; identical to SEQ ID NO: 92766
  chr5:112824066-112824317
  Hyper

SEQ ID NO: 124841 - DNA, 83 bp, Homo sapiens; identical to SEQ ID NO: 92768
  chr5:113391056-113391139
  Hyper

SEQ ID NO: 124842 - DNA, 831 bp, Homo sapiens
  chr5:113391377-113392208
  Hyper
ctctgcagctccccccggttaacacccgaaattcggccttagaatacacacacacgatggaatttgttccatatctttttttttaaccttcgataggcataaatccaaacctaaaattaaaatcatccccaaatttggttttgggaatcatgttggttttcacccttgagcggcgttccctccccagtgccgcatgctgcttaaggactgttactttcttggggagggaagtatcaaatggaaacggtgtgtgtgtgcgcgcgcgcgtttatttttggcgcatgcacacccctcggtagcctcaaggtcggcgataccctgagcattcgggcccccgcctgcaggactcgctcctgccagccaaggactcaagaaggagggagtccccagtcccggcggggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagccgggggcgctctcccgggccgcaagcaggcacggaatttgacgcccgagaggcagatggtcctggctaggactcctgattcttctcagatggaaacagtttctcccggtgaacctgccggaattctcagtggactcgatcttcagctttgtccactggcgcatttcaccaaggccgcatttaccgctttgaggcaaatttgagcttcaaatggagcgggactcctggttgcagaacgaggtaaggtcgcg

SEQ ID NO: 124843 - DNA, 315 bp, Homo sapiens; identical to SEQ ID NO: 29821
  chr5:113696418-113696733
  Hyper

SEQ ID NO: 124844 - DNA, 1216 bp, Homo sapiens
  chr5:113696951-113698167
  Hyper
gcccccacccacccccggccggggtgccgaggcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcgggcagccggcagcccactctcggcgggatgatctgggagaagcgggcgtgggacgagggggctgctgttttgcagccctgcgaggcgtgcagtcggagaagtggtcggggttccacaccgtccctgagcctgcccccggccaaggtggcccgacgtgctgcagtggctggcgcaggtgatccgggcagcgcgtccggcactagtcaagggggcagcggcacgggagggaggggcgcctttctcttttctcctccccctgcagcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctaccggagccggcatgggcccttcctcgcaccagcagcaggagtccccgctcccgaccataacgcattgcgcagggtgcaccaccgcttggtctccctgcagctttaacagccctgacatggaaaccccattgcagttccagcgcggcttcttcccagagcagccgccgccgccgccgcgctcctcacacctgcattgccagcagcagcaacagagccaggacaagccgtgcccgcccttcgcgcccctcccgcaccctcaccaccacccgcacctcgcgcaccagcagccggccagcggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgt

SEQ ID NO: 124845 - DNA, 733 bp, Homo sapiens
  chr5:113698386-113699119
  Hyper
accaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtcag

SEQ ID NO: 124846 - DNA, 293 bp, Homo sapiens; identical to SEQ ID NO: 92777
  chr5:113699370-113699663
  Hyper

SEQ ID NO: 124847 - DNA, 30 bp, Homo sapiens; identical to SEQ ID NO: 92781
  chr5:114506521-114506551
  Hyper

SEQ ID NO: 124848 - DNA, 735 bp, Homo sapiens
  chr5:114514936-114515671
  Hyper
gcactgactcaggcccggcaccaccccgcctgctgagggcgtcgtcgcgggcgccaccgacggcgccagcctgcgttcctaaaggctccaggacaggtgtggggctgaaatcccgctcctccagcatcttcccctccctaccaaaagaaggctgctttaaatattcccggcctggagcagcagcagctaaggacctggaaagaggcccgaaaaggccagggcagggcgaacgaacgtgctgtccctatttaccggccacacgctctgactgcgggctgaccctgatcgcacacttcgagcctgttcactcgctgggcggaccctccctccacgctccgcgcccaggcaggcgaggtcacccactcgaagtcaccacgtttgagtagccctggttggtggggcagcgcccccttggccaacgccccgccctcctctccatcttccgacgctgggctctcgcccttcggcgtccgagagcccctattgctgcccagctggccccaaaagcgtccgaaagtcccctcttggcttatttcagagatgccacgcaataaagaaaaggcggctactttgcattccgcagctgctgggacgcccgggctgcgagcgcggctcctggattccagcctcccgcccttcccaggcgctggaatggacacggacgcccacagtggcgggccaggtagtgccggagtcgggggcccaggccgcggcgccccgcgcctcatcacttac

SEQ ID NO: 124849 - DNA, 374 bp, Homo sapiens; identical to SEQ ID NO: 92784
  chr5:114515900-114516274
  Hyper

SEQ ID NO: 124850 - DNA, 157 bp, Homo sapiens; identical to SEQ ID NO: 92785
  chr5:114972859-114973016
  Hypo

SEQ ID NO: 124851 - DNA, 1702 bp, Homo sapiens
  chr5:115151163-115152865
  Hyper
gggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcaggcgaccgaaggcgcagtgatggagaactgacgcgggtgacttgtcttcttcaacatcacacacttctcccgatggctgatgtagtgctcccctgggagcaccctctgctagtccggccagacggttccttaaggtgtcaggagggcccgaacctgagtgcggtctctccgcatctccgcgcccggggttaacgatggcttgggagtgtgggcattgctcccgaggccaggggcaggaggactggtggtttagaagcagaggggtttgcgggagagaagagaacagaaaatctcgcagacgcgcggtggcctcccttcccggcgcctgtccgccgttcccggccggaggtcagcaaggccagtaggatccaccttccgcctgcgctgtggccgcggagccccaagcgagtcgtgccagccccgcggctggccagcgagggggcgagcggcggacgcagcgcggcccgagcttcccgagccagtcactttgggctgcgtcccccacgtccattcctcctcagacggggcgagtgggcgccgcctggcattgaagctgcagcgcgctcacctgtactggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaagcgcttggagtcactaggaatgtaccaacggccctcggagggaggacgaggcggagagccacccaagaaaggtggcggaggcggggagaccctgcgggcacggctcacgcgcacatccccggcttccccgggctccgcgccttcccaagagccccgttgtctccggcgtcccagggatcgcgtgggctccgcgcaatctctcccccactttaacggcgcgttttagccgcccggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggc

SEQ ID NO: 124852 - DNA, 32 bp, Homo sapiens; identical to SEQ ID NO: 40582
  chr5:115176272-115176304
  Hypo

SEQ ID NO: 124853 - DNA, 1958 bp, Homo sapiens
  chr5:115297158-115299116
  Hyper
ttcccaattcaccagcgtgcgtgaatgcagactccagatccagcgcagacgccaagaattcgctcaggggcaccagctaaatagcaaacagatgccatgtcaaacatgtgaaagcctcagcgactagggtaccgccgggaaaaccagttccagcccaggaatttctgggtggaaacactggccgccgaattgttttattctctttgcttgattcgagtcggttctgaaagcaggtgtcccctctcccccggcttcaggaagggaaaccccggccccaggcagttgcagagctaagaaaaaccatcccgccaggccccttcttgtggtaacgcggtcctaaccctgctctgccccacaaccccatttcacccgggagacgcagacgccaggctccctagcactttgtcgcctcttcctccagcctggcttcctgagctctggaaaagttccgggcctccggacgttgtttccatcttcgccttcgctgcctgggccgcatgcctcctgggcttatttaggaagcgaagttagcgccacacatttggctccagaaatttgttctgacggcgcggccgacgccctgcagggtcatttctgaacgcattcccaaatatcctggtcctcaagcccttaccaccccctagcacacgaagccccagctggcggtggagcaggtgtgttgctggtagctcatcgctggcttggagatagaggtgcttggtacctgtcccctttccgacaacacctgaaaccgtatcggggcacacccctcatccaaatatccacgtttaaggtgtccggattcgtttggcttgaccaccccctccccgcgccaaccctggaggcatcttccgtggggtctgtctcttcgaacccaaaggggtacgcgtctgggtgagccaggtccgcctcttccctggcgctggccgggggcgggggtgggtaggctgggacctgtgtctgattagctgggagggggaagccatggtcccaaccgctgtctgctgagctccagtccgtccaggctcttccaggaggaagaggcacgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcctcttccaggactgcgagcgcgccgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgcgtctgctgcccttt

SEQ ID NO: 124854 - DNA, 30 bp, Homo sapiens; identical to SEQ ID NO: 29841
  chr5:115908915-115908945
  Hyper

SEQ ID NO: 124855 - DNA, 400 bp, Homo sapiens; identical to SEQ ID NO: 92797
  chr5:115909717-115910117
  Hyper

SEQ ID NO: 124856 - DNA, 267 bp, Homo sapiens; identical to SEQ ID NO: 92798
  chr5:115910908-115911175
  Hyper

SEQ ID NO: 124857 - DNA, 138 bp, Homo sapiens; identical to SEQ ID NO: 92799
  chr5:115911452-115911590
  Hyper

SEQ ID NO: 124858 - DNA, 279 bp, Homo sapiens; identical to SEQ ID NO: 92800
  chr5:115911835-115912114
  Hyper

SEQ ID NO: 124859 - DNA, 223 bp, Homo sapiens; identical to SEQ ID NO: 92801
  chr5:115958432-115958655
  Hypo

SEQ ID NO: 124860 - DNA, 30 bp, Homo sapiens; identical to SEQ ID NO: 92802
  chr5:116052021-116052051
  Hypo

SEQ ID NO: 124861 - DNA, 22 bp, Homo sapiens
  chr5:117258296-117258318
  Hypo
ccgcgcccggccaaaatatccc

SEQ ID NO: 124862 - DNA, 1650 bp, Homo sapiens
  chr5:119799856-119801506
  Hyper
cctggcgcggcagcacggcgcccctctccgcgggcggggagcgagcgcgtgtgcgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtgagaggcgcaggggtggggagggagttcggcacccttcgacccctccggggtcccctttccgattttcagcagggacagccagatttccaaactcctgggaaactacagaaaaggcgcctgcagacggactttctttgctcctggagtcctgagaggagttgttgttgcactttttaatttttttttttaatcaggaagaaatcaactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtggctgcagcgggaaaaggggtggggcgtagtctaggtcca

SEQ ID NO: 124863 - DNA, 26 bp, Homo sapiens
  chr5:120884207-120884233
  Hypo
aaaaaataacttgcccgccaggcaca

SEQ ID NO: 124864 - DNA, 1291 bp, Homo sapiens; identical to SEQ ID NO: 92822
  chr5:121412520-121413811
  Hyper

SEQ ID NO: 124865 - DNA, 56 bp, Homo sapiens; identical to SEQ ID NO: 92823
  chr5:121414034-121414090
  Hyper

SEQ ID NO: 124866 - DNA, 1112 bp, Homo sapiens; identical to SEQ ID NO: 92824
  chr5:121647381-121648493
  Hyper

SEQ ID NO: 124867 - DNA, 292 bp, Homo sapiens; identical to SEQ ID NO: 92825
  chr5:121648747-121649039
  Hyper

SEQ ID NO: 124868 - DNA, 40 bp, Homo sapiens; identical to SEQ ID NO: 92829
  chr5:122371217-122371257
  Hyper

SEQ ID NO: 124869 - DNA, 30 bp, Homo sapiens; identical to SEQ ID NO: 92830
  chr5:122371686-122371716
  Hyper

SEQ ID NO: 124870 - DNA, 30 bp, Homo sapiens; identical to SEQ ID NO: 92831
  chr5:122372558-122372588
  Hyper

SEQ ID NO: 124871 - DNA, 86 bp, Homo sapiens
  chr5:122422237-122422323
  Hyper
cgggggtccagcttacgccgctgcgcgcccttgtgcgcaccgggtgaggatgccgagctctgcgggcatcccggaagccgcggtgg

SEQ ID NO: 124872 - DNA, 218 bp, Homo sapiens; identical to SEQ ID NO: 29853
  chr5:122422616-122422834
  Hyper

SEQ ID NO: 124873 - DNA, 208 bp, Homo sapiens; identical to SEQ ID NO: 92834
  chr5:122423168-122423376
  Hyper

SEQ ID NO: 124874 - DNA, 30 bp, Homo sapiens; identical to SEQ ID NO: 92835
  chr5:122423599-122423629
  Hyper

SEQ ID NO: 124875 - DNA, 231 bp, Homo sapiens; identical to SEQ ID NO: 92836
  chr5:122423874-122424105
  Hyper

SEQ ID NO: 124876 - DNA, 252 bp, Homo sapiens; identical to SEQ ID NO: 29856
  chr5:122424436-122424688
  Hyper

SEQ ID NO: 124877 - DNA, 1939 bp, Homo sapiens
  chr5:122424910-122426849
  Hyper
aacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacgcggctcgggcgctgcgccacgccggctcgggtcggctccgggcgctggctgagggcgggggctgcgtcctgcagccgagttctacggggcagcgccctcctgtcgggccccagcattgctggatgggagctggacgctgcgatcggggaggcagagcagggtgcacacagctccctctgtgcggcgccgcagcttcggagtaaactttgcgcccaagcggagttgggaagagggagccgcggaaccgggcggccgccggctgaaccaccggctcgggcactttctccagggtcccagtggccctcttcccggcccctttcgcccagctcacgcgccccctcttccctgccctctgcccccagttcgaggcgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgccggcttcctcttccacctccgcctcctccgcctcctcctgcgctgctgcggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggtggggagcacctggtcctggccgctggcccgcgcctccccgatctctgtgacaaaagttttctggcgttggagaaggaaagagaacggatgggacggccggtggcactttggggttccctctccctccctctcctcacctgcttcacagtcccaagtgtttggggccggagtctaccgtggacccggcctaacagacctctgccctcccgccggacagtgcccggggccaggcgggtactggcagcgtgtgacagggggtgtctgggtcaggccctgcctggccttagccgggacgagggagggaccctcagcgtctctggggagcacgcagaccagggcttgtttttgctactctccaccccacctctggaggggtcattttcgggccgcggggttgtgggggaaccggcgggagctgttcgctggccaggcctc

SEQ ID NO: 124878 - DNA, 1031 bp, Homo sapiens; identical to SEQ ID NO: 92842
  chr5:122430402-122431433
  Hyper

SEQ ID NO: 124879 - DNA, 47 bp, Homo sapiens
  chr5:122434072-122434119
  Hyper
ggtcgcgccggcgggcgccgaggccaccttctcggggcaggccatcc

SEQ ID NO: 124880 - DNA, 302 bp, Homo sapiens
  chr5:122434428-122434730
  Hyper
aacaattaggctgatcgttaaatttgctattcctttcttccggcgtctagggagagcgtgcacaccaaaccctccagaacagcaccccggtcccccaccccgccccacctgtccccgccctgcttcagtgcctggagggagaactgactggtcgcttgagggaccccatttcgggcgcgcccttggagtcctggggctgcggctcctgctctaccgggctgcaggcttgctctgccccgtcccgtggcgtttgggaggcagtcgaggaagcctccgagtctctgggtcgaaggaagtgcgaa

SEQ ID NO: 124881 - DNA, 58 bp, Homo sapiens
  chr5:122621293-122621351
  Hyper
tcccagggcctgaggcgcaggaacccactgcccggggccccagcgctgtcagcccctc

SEQ ID NO: 124882 - DNA, 30 bp, Homo sapiens; identical to SEQ ID NO: 92849
  chr5:124082412-124082442
  Hyper

SEQ ID NO: 124883 - DNA, 516 bp, Homo sapiens; identical to SEQ ID NO: 92850
  chr5:124083366-124083882
  Hyper

SEQ ID NO: 124884 - DNA, 107 bp, Homo sapiens; identical to SEQ ID NO: 92851
  chr5:124084195-124084302
  Hyper

SEQ ID NO: 124885 - DNA, 206 bp, Homo sapiens; identical to SEQ ID NO: 92852
  chr5:124084771-124084977
  Hyper

SEQ ID NO: 124886 - DNA, 84 bp, Homo sapiens; identical to SEQ ID NO: 92853
  chr5:124128502-124128586
  Hypo

SEQ ID NO: 124887 - DNA, 476 bp, Homo sapiens; identical to SEQ ID NO: 92856
  chr5:125930586-125931062
  Hyper

SEQ ID NO: 124888 - DNA, 30 bp, Homo sapiens; identical to SEQ ID NO: 92857
  chr5:125931300-125931330
  Hyper

SEQ ID NO: 124889 - DNA, 18 bp, Homo sapiens
  chr5:125937930-125937948
  Hypo
gcccggcccagcttccct

SEQ ID NO: 124890 - DNA, 337 bp, Homo sapiens; identical to SEQ ID NO: 92859
  chr5:126199749-126200086
  Hypo

SEQ ID NO: 124891 - DNA, 35 bp, Homo sapiens; identical to SEQ ID NO: 92860
  chr5:126327499-126327534
  Hypo

SEQ ID NO: 124892 - DNA, 97 bp, Homo sapiens; identical to SEQ ID NO: 92861
  chr5:126328776-126328873
  Hypo

SEQ ID NO: 124893 - DNA, 150 bp, Homo sapiens; identical to SEQ ID NO: 92862
  chr5:126339372-126339522
  Hypo

SEQ ID NO: 124894 - DNA, 144 bp, Homo sapiens; identical to SEQ ID NO: 92863
  chr5:126366959-126367103
  Hyper

SEQ ID NO: 124895 - DNA, 30 bp, Homo sapiens; identical to SEQ ID NO: 40585
  chr5:126409452-126409482
  Hypo

SEQ ID NO: 124896 - DNA, 385 bp, Homo sapiens; identical to SEQ ID NO: 92866
  chr5:126626332-126626717
  Hyper

SEQ ID NO: 124897 - DNA, 30 bp, Homo sapiens; identical to SEQ ID NO: 40586
  chr5:126851264-126851294
  Hypo

SEQ ID NO: 124898 - DNA, 146 bp, Homo sapiens; identical to SEQ ID NO: 92869
  chr5:127537084-127537230
  Hyper

SEQ ID NO: 124899 - DNA, 2332 bp, Homo sapiens
  chr5:127872845-127875177
  Hyper
ccgcccgctgagctgcggggttgggaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggccggggcggcttgggcggaggaggctgaggctggccggccgtgccctgcgcccagagcaccacacagcccagccacaggaagtagagctggagacacagcctccgtcttctccccatcgccggcgccgaaagcgcgcggccgtagacccgcggagagggagtgatcaaagacaaaatctgcgcgcctcagaaaagagtcagggtctaataagcccttcgtcggctccggggactccctcgggctcgggctccctgctctagctggagacctcgacagagcgccggccccctgactgcccgcgaagcgagacgcggggcgccgggtctagcgcagtgagcggcgaggcgcggcggaggtgcagccggcagccccgagcggtacacgttgcataaccggcctaaagccccgagcgactccaggaccgtcagcgggcgggggaggaaattacaaaagccctggcgtaaaatttcaaaaaatgtgaacctcaaaagaaaaaagggcctgcacgcagagctcggcggattcccgtgcgctccgaagacggatattggaaagctgcaaaagtcaccagaaagaaacaggcaagcaaacaaaagtcgcccccagaagaagaggagggttccctccgggctcgctcggagtcccacagggcaacgaagcgcgggtagcggctgcggagccgggcggaggtgcgcggggccggggcgtgcggccagcaagagagagggcgggaggctgggcgctggagaagatgcggcggtggagggcgcggcgcgggggttttagaggcccggcggggcgcggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggcgattagggaccggatttgggaaaggaggcagcagccccttcccctccccctccgtcctcgcccggccgcggaccagggactagggtgcctaagcgcgccaggcttggccggacccgcagctgaactgacccgcagctgaacttccccgccggacagaggccgcaaggttgaggatgagaacgggtctttctgtagggtcccggcccctgacctgggatggggggattcgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccgtgcaggggtgtgctctggtgtgaaacctggcaggactctgcctgggcttgcatgcagggaggggttagagactctgaaatgtactagcgggcagggtggtgacaaggcgggtaaatgaggctcggggcatgcccttgcttcctggcttggaccccttctgattgattaaatcctagcaattggtgcaaccctctgtacctcttagagtgcctctcaccggcctgctctgggt

SEQ ID NO: 124900 - DNA, 656 bp, Homo sapiens
  chr5:128300655-128301311
  Hyper
tggatgacctttgtgcgacactgttataccttatcagcctcgccagggcccccgcgccgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagc

SEQ ID NO: 124901 - DNA, 2014 bp, Homo sapiens
  chr5:128795456-128797470
  Hyper
acccacctctctagtcgtgtcttcccatctccctactcattccctcccgcgccgctgcgggtgagagccttcagcggtgcgtcctaaggagcgtgaggagtgtgcggagcttggcacaccaagttgctgagactgtgacaccagcctccgcccgttccgcgcgggtgcaggcggcgagcctcggctcggacaccacagctctcctgcccgcgccgggcagtcctctgcctgtccagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaaccgcgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtctttgcatcggttttcttttcaacaatgaagtgcggtcaccaaactttgattccccctcccccgcccctaatataatcgtacttttactctgaaaatgctggggtctgtaatctgatcgcaaggcttctggggttgcagagtttcagggtctagacgggtggtctccattgcattcaacgcgagcgccctgtatctatggactgtgagcttggaaatgtttgtgctactggaaccgcggcactttaagccccgcacttctgtctgccccgcccgcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 124902 - DNA, 45 bp, Homo sapiens; identical to SEQ ID NO: 92881
  chr5:129239737-129239782
  Hyper

SEQ ID NO: 124903 - DNA, 877 bp, Homo sapiens; identical to SEQ ID NO: 92882
  chr5:129240024-129240901
  Hyper

SEQ ID NO: 124904 - DNA, 35 bp, Homo sapiens; identical to SEQ ID NO: 92883
  chr5:129241105-129241140
  Hyper

SEQ ID NO: 124905 - DNA, 466 bp, Homo sapiens; identical to SEQ ID NO: 92884
  chr5:129241413-129241879
  Hyper

SEQ ID NO: 124906 - DNA, 30 bp, Homo sapiens; identical to SEQ ID NO: 92889
  chr5:130331203-130331233
  Hypo

SEQ ID NO: 124907 - DNA, 92 bp, Homo sapiens; identical to SEQ ID NO: 40587
  chr5:131305994-131306086
  Hypo

SEQ ID NO: 124908 - DNA, 403 bp, Homo sapiens; identical to SEQ ID NO: 92891
  chr5:131346834-131347237
  Hyper

SEQ ID NO: 124909 - DNA, 162 bp, Homo sapiens; identical to SEQ ID NO: 92892
  chr5:131347627-131347789
  Hyper

SEQ ID NO: 124910 - DNA, 427 bp, Homo sapiens
  chr5:131593088-131593515
  Hyper
agctgggtttgggtccgcggcctgcagatccaaggcccgagcaggatccaggccgtcggggccgtccgaacgcggggatctctgagagctgagtgggggtgccgggttgccggcagccggggctgagggcgggtcctcagagccccccgaagtgggagggtcgggctggccgcggggccaatccaggcgcacagggagcgggggcgggggctgggccgagtggggacaggggcgggcgggccgggggcgggcgcggcgtccaggcggcggcggcggctgcggcggcggcggctcctcctcagagtccggctcaggctccggctgcggctccagcccgcgatgccccattccgtgaccctgcgcgggccttcgccctggggcttccgcctggtgggcggccgggacttcagcgcgcccctcaccatct

SEQ ID NO: 124911 - DNA, 30 bp, Homo sapiens; identical to SEQ ID NO: 92895
  chr5:131608230-131608260
  Hypo

SEQ ID NO: 124912 - DNA, 30 bp, Homo sapiens; identical to SEQ ID NO: 92896
  chr5:131608541-131608571
  Hyper

SEQ ID NO: 124913 - DNA, 227 bp, Homo sapiens; identical to SEQ ID NO: 92897
  chr5:131610019-131610246
  Hypo

SEQ ID NO: 124914 - DNA, 267 bp, Homo sapiens; identical to SEQ ID NO: 92898
  chr5:131613605-131613872
  Hypo

SEQ ID NO: 124915 - DNA, 30 bp, Homo sapiens; identical to SEQ ID NO: 40589
  chr5:131787174-131787204
  Hypo

SEQ ID NO: 124916 - DNA, 242 bp, Homo sapiens
  chr5:131800302-131800544
  Hyper
gcttgctgtcagccccgggggtggtttcctctctaggaaaagctaatgtcatgcttatgctgaaaaactcttttcagaggtactttaggaggggcctggctctcgattaatctgggccatttcataccggctgtgctcacccaggcacaaacactgaaagcaacagctggcaaagccatcgcttggtagcagcttggaagacaccaccaaagaagctctcatggaagcggcagatttcctga

SEQ ID NO: 124917 - DNA, 532 bp, Homo sapiens; identical to SEQ ID NO: 92900
  chr5:131991814-131992346
  Hyper

SEQ ID NO: 124918 - DNA, 492 bp, Homo sapiens
  chr5:132083017-132083509
  Hyper
aggcgcggcccggtgcgccagaggtagctccaccgcgagcgttgtgggtggggcccgccgagcccgcctccccacctcccccggcggcgccccaggctgcagtgttccgggagctgggttataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggagcggcctccctccacgcggcgtccgcagcagtccccgtgcggccccggcgcggtacggcgccagccgggaaaaccgcagacgcggtccccgccgccgccccagagcaagctccgcggccggctccacagtccc

SEQ ID NO: 124919 - DNA, 98 bp, Homo sapiens; identical to SEQ ID NO: 92903
  chr5:132083866-132083964
  Hypo

SEQ ID NO: 124920 - DNA, 77 bp, Homo sapiens; identical to SEQ ID NO: 92904
  chr5:132113493-132113570
  Hyper

SEQ ID NO: 124921 - DNA, 96 bp, Homo sapiens
  chr5:132149831-132149927
  Hyper
caccgagagaccctccgcagacgcggccccaccgcctagggccccttctgaggcggcatcgccctgctctgatccgccagacgcggagcccgggcc

SEQ ID NO: 124922 - DNA, 54 bp, Homo sapiens; identical to SEQ ID NO: 92905
  chr5:132201467-132201521
  Hypo

SEQ ID NO: 124923 - DNA, 20 bp, Homo sapiens
  chr5:132399919-132399939
  Hypo
aggtgcggtggctcacgcct

SEQ ID NO: 124924 - DNA, 30 bp, Homo sapiens; identical to SEQ ID NO: 92907
  chr5:132759633-132759663
  Hyper

SEQ ID NO: 124925 - DNA, 60 bp, Homo sapiens; identical to SEQ ID NO: 92908
  chr5:132888793-132888853
  Hyper

SEQ ID NO: 124926 - DNA, 1822 bp, Homo sapiens; identical to SEQ ID NO: 92909
  chr5:132946707-132948529
  Hyper

SEQ ID NO: 124927 - DNA, 30 bp, Homo sapiens; identical to SEQ ID NO: 92910
  chr5:133262317-133262347
  Hypo

SEQ ID NO: 124928 - DNA, 168 bp, Homo sapiens; identical to SEQ ID NO: 92911
  chr5:133406834-133407002
  Hyper

SEQ ID NO: 124929 - DNA, 251 bp, Homo sapiens; identical to SEQ ID NO: 92912
  chr5:133449673-133449924
  Hyper

SEQ ID NO: 124930 - DNA, 27 bp, Homo sapiens
  chr5:133682096-133682123
  Hypo
ttgttaaatttgtcacgcttttctctt

SEQ ID NO: 124931 - DNA, 120 bp, Homo sapiens; identical to SEQ ID NO: 92914
  chr5:133820016-133820136
  Hypo

SEQ ID NO: 124932 - DNA, 71 bp, Homo sapiens; identical to SEQ ID NO: 92915
  chr5:134242171-134242242
  Hypo

SEQ ID NO: 124933 - DNA, 30 bp, Homo sapiens; identical to SEQ ID NO: 92916
  chr5:134256782-134256812
  Hypo

SEQ ID NO: 124934 - DNA, 96 bp, Homo sapiens; identical to SEQ ID NO: 92917
  chr5:134339741-134339837
  Hypo

SEQ ID NO: 124935 - DNA, 30 bp, Homo sapiens
  chr5:134363215-134363245
  Hyper
cggacaggctcgcaacgcaggacggtgccc

SEQ ID NO: 124936 - DNA, 47 bp, Homo sapiens
  chr5:134363562-134363609
  Hyper
gcagggccctggggccgcgccccttgctctgccggctcgactcttgc

SEQ ID NO: 124937 - DNA, 92 bp, Homo sapiens
  chr5:134364113-134364205
  Hyper
gcgccgcgtgccctccgcggagtgggcctccggggcccgtgggaacacacacaccacccgcgccatcccgagagaaattgcaactcatccat

SEQ ID NO: 124938 - DNA, 332 bp, Homo sapiens
  chr5:134364265-134364597
  Hyper
ctttttggagggcagagtggggtccggaaaagcaaacacaaaaccaacccggagtgggaagtgggaggagggggctgcgcaggtgtgaggtccgcggcgcggtgagctggggcttgcgagccggggccccgcgtgcgtcctccgcgcccgcgcccgcgcccttccccgctccggccgccggcccgcgtggtgcggcggggcggtcagctgttgtactggcacgcgttgaggcccgaggccgggccctgcaggccgccgtagccaaacgacgagtgctgtttggacttgagccgcaggctggctaggctcgagttgcacgtgtcccggtagac

SEQ ID NO: 124939 - DNA, 67 bp, Homo sapiens; identical to SEQ ID NO: 92918
  chr5:134365027-134365094
  Hyper

SEQ ID NO: 124940 - DNA, 587 bp, Homo sapiens
  chr5:134366718-134367305
  Hyper
ggggttgccttagtccgaggatcaggtaggatgagggtcaaaggggttgaaggtccgaggcgcctggaggcctggcagacgctagtgggccagggcctaaggtggggatctccggtggagggagggagcaggtctgaatggtgggagagtgaagttctgcttgtgggtctaagctttggagggctgcagcagaggcggcccgggagccctctgcgcgggtgcccttaggcgcgcaccccttgctcacccgcacgcgcggctcggtgaggttggtccacacggcgatctcctccctcatgctcatgtcggggtagcggttcctctggaacgtggcctctagctcttgcaactgctggcttgtgaagtgcgtacgttgccgccgctgcttcttcttcttggctgggtcgtctgcgccgccgcagcccgtgcctcccgcaccactgtcctcgggccccttgggttccccgccgcgctccttctctgcagtaggcaggacggggagcgggtcacctgggcttacgccccgttgcaccccgtcccggctccaccgaaccgctcgccaccagcgctggcggtcttccctccct

SEQ ID NO: 124941 - DNA, 124 bp, Homo sapiens; identical to SEQ ID NO: 92921
  chr5:134368720-134368844
  Hyper

SEQ ID NO: 124942 - DNA, 1404 bp, Homo sapiens
  chr5:134374447-134375851
  Hyper
tcaatttcagaaatccgagacccggttcttgagaagcgactgcgtgctccgggaccctgcgtcaacaaccaaacctgggagaagccgcgggaatgtctttattggacgttacgaagggaattggggtttctctcctgggaagaaaaagcccgacctgtgccggcgagagcaggctgccttgggctgggggcacctccgagcgctgcggcgggacgtcggggtccggggcgaagagagccagggcgcggaccgacgtctgctgcttttctgcggcattgctgcccgaacgaacgaacgaacgaacgaacgaagcggtttcgtttaggaaaaataccctcttgacgcgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggtttt

SEQ ID NO: 124943 - DNA, 163 bp, Homo sapiens; identical to SEQ ID NO: 92924
  chr5:134376212-134376375
  Hyper

SEQ ID NO: 124944 - DNA, 207 bp, Homo sapiens
  chr5:134376656-134376863
  Hyper
ggcgtcctgctagtccgtgcctccagggccgcttggcctgggaacgcagagacccacgaccccctccccaacctccgaagcgggaagccggcccgacccaagctcacagaggcctcggtgttcaggccctgccaggtggcctctgcaccctgtcgtgctgttccagggactccataccctcctctcaaccctcgacagcaggaaccc

SEQ ID NO: 124945 - DNA, 494 bp, Homo sapiens
  chr5:134385889-134386383
  Hyper
caccaggagctgtctcgggacctgggaagggcaggagggcgaggggctagggcgatggaagggggagatcaagagtggcgcggcagggggagagcgccctgagcctcgctggagcccatcccggcatggctgctgggaccgacaggccgatcgcgggccgcgagcacatctcacagagcctgggcacagagggcccgaactgtgcccagcgaggaggacgcgtgtgggttttgcctgcaagggttctgaccacttggggacagcgagggcgcgtagaggcgcggagctcactacgcgccgcctcactcttccgcgcgaggtgccgggtggcccagcagcaggtgctcgcgcgcaggtccagagcggcgcgttgcagagcccgctgtgccaccggagaaccgtggagcagccagggccgcactcgggcgtctgtccccagcctcatggttgccagcagagctggcgcaggggcgcgcaggcggtgagagcaatga

SEQ ID NO: 124946 - DNA, 120 bp, Homo sapiens; identical to SEQ ID NO: 92928
  chr5:134583042-134583162
  Hypo

SEQ ID NO: 124947 - DNA, 109 bp, Homo sapiens; identical to SEQ ID NO: 92931
  chr5:134801812-134801921
  Hyper

SEQ ID NO: 124948 - DNA, 144 bp, Homo sapiens; identical to SEQ ID NO: 92932
  chr5:134802222-134802366
  Hyper

SEQ ID NO: 124949 - DNA, 89 bp, Homo sapiens; identical to SEQ ID NO: 92933
  chr5:134824488-134824577
  Hyper

SEQ ID NO: 124950 - DNA, 30 bp, Homo sapiens; identical to SEQ ID NO: 92934
  chr5:134824825-134824855
  Hyper

SEQ ID NO: 124951 - DNA, 56 bp, Homo sapiens
  chr5:134825103-134825159
  Hyper
gggcgcctggccttgcgcgcctgttcccctgggagccacttcgtctccctgggtgt

SEQ ID NO: 124952 - DNA, 1126 bp, Homo sapiens
  chr5:134825383-134826509
  Hyper
tgtttaaaagggggccgagagcgagggcgcccaatctttgaactggtcgggttttgcatgcctccgctccgagcccgtggagcgctgcacaaaatcgtctagcgcggagcagggcggggacggggagagacacaaaacaatcctcgggctttctcgctactgagccttcggggccgtttccccaagcgcaaacagatgcaaatgtctctgcaaacattgcacaaagctattcagagagaggcagcctctcgcggcctcaatagccctttaaacctagtccaattgcccccaagtagaggtaaagagtccacatgcattttttcactttggctggaagaggggcggaggaggcgagggccttggggagcaaggtatgagggctgctctggttcagcggttcgtgccatcgacccgagctgcagcgtgcggaagaccggcaggagagtgcggtggctcgggggactacgcgcttcgggccgggcggggattgaggtgcagccgaagctggtgccgcgggaatgcgcggaccggagaggcccccgggacctttcaggcccacaaacgccgcgctaaatagccacgcgcacaatagcatgaaagggctcactcggaccttactgcaacacagtagattcacacccctccgaggggactaataagctcgtaactaacgcgcaacgctcagcggtgagagcgggcttgcgccctgctggcccctcgcagtacgcagactcagtctttcagcgtcactcggaggcccaagggcagccgctgcacggagggccaggcatttccttctaacctcgccagtagaggagcctggggcctgccggtgcagtccttaatgcaccccaaactcacgtggggctggcgaccccggaggctcggcatttcctggcccttcagaagacgatgtcgggacctctagactccaggctgagcgaggaagaagctccagtaaaagatgccagcgtaggcgcggtcttagccagctgtggccaagccgcctccacctccagttcagggccggggcctttcccgtcgccgcacgcagcaggtgctctggacgcgatgggcggcctagccagagcaggcacgtgcgctgagggcccggaaaagccccttc

SEQ ID NO: 124953 - DNA, 1717 bp, Homo sapiens
  chr5:134870423-134872140
  Hyper
tgcaaaaggaaaggccgtctaggggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatccgccaggcgcagtgtctcggccagagcccagatgtagttgtaggcgaagcgcagcgtctcgattttggtgagcttggtgtcgtcggggaacgagggcagcacgctgcgcagtgcgtccagggccgcgttcaagttgtgcatgcggttgcgctcgcgatcgttggccttgacgcgccggctcctgcgcagcgagtgcagcagcgcctcggagcggacccgcgtccggccgcggcgccgccgcctctcctgctcgtcgtcctgtgcccctggaacctcagacgcccgggagatattgggcgcgcccctgcgggccggcgcgggcggccccgaagcggaggctgcctgttggagtctggcacagtcttcctcgtcggtgaggaagccggataggtcactgccgctgctgctggcgcagtcgaggtcggagatgcaggtctcaaggcgggctggcatcgttgcgctgtgcaggaccgacggacagatagaaaggcgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagtgtgagccgcccagtgagttgcggaaacctggagggtacttggagtttgggttcgcatcccctctccagctgcttagtggtcgcgtgactttggacga

SEQ ID NO: 124954 - DNA, 702 bp, Homo sapiens; identical to SEQ ID NO: 92941
  chr5:134879271-134879973
  Hyper

SEQ ID NO: 124955 - DNA, 461 bp, Homo sapiens
  chr5:134880153-134880614
  Hyper
ccggaagagctgggatggagaataaggatgaattctggagggaaatccggcaaaacgggcattggcactaaaataggacattcgttaaggaaacaacaaagatggctgaagaatggagtatggctgaaaaaagcccactggagaggtgcagatagtcccctctgggcgccttccgaggttgggagggcattctggcccccgcccctccccgccgcaatctgtcgggacccgccgggtttccatatgaagggtcgagccggcgccttgggagcgctgaatggccgctcgcggtccggcgggcgcgcacgccccgcggcccgggctggatttggccgcatttgcatagcaggtgctgatgcttgtccattcttacttaaagaagttttaatatgggataaattaccaggaactaggagctgacgtgggcgggaaaaaaggaatcgtgtcgccagccagtcttc

SEQ ID NO: 124956 - DNA, 885 bp, Homo sapiens; identical to SEQ ID NO: 92943
  chr5:134914192-134915077
  Hyper

SEQ ID NO: 124957 - DNA, 290 bp, Homo sapiens; identical to SEQ ID NO: 29911
  chr5:135170256-135170546
  Hyper

SEQ ID NO: 124958 - DNA, 278 bp, Homo sapiens; identical to SEQ ID NO: 92945
  chr5:135170915-135171193
  Hyper

SEQ ID NO: 124959 - DNA, 1004 bp, Homo sapiens
  chr5:135265701-135266705
  Hyper
gcattgataaaggggcgcccttcatcgggagtaagtcccagaaaccacaagcgttggctcatgcctgtgtggagtcacaggcaggtggccacggggaattagctgaagaccagcaggcaggaagcctcccacatgccacctaaggggcgctcccggaaccgccgcccctgcgggaggagcggctggggtctcagatcgccgtgcgtgacttggtgctgcgccaggtgggcgccatcgccgcggcctgctgggggaggcggcctttgaggagcgggcgcgaggcggggccaggcggggcggggccttgggcggctgcggtctgcgcggacccccgtgcctaggcgctcctgtgcctccagtgcgcggagccggcctcgctcgggcgtgttcctgcgccgaccggacggccggactccagcaccttggcccggcccgcgaacgctgagcacgcgcggaaaccctttaaaggtagcacatttttcgggtgtcgcgggggcaccgccggcggtggcgacgtggggcggaatgggctcgctctttgggcccgggaggcgtgcgctcgcgccctgggccacgtcggggcggtctcgggcggctgagcgccccctggagcgacccctcccgcggcccgggcccggccgcccccgaagccggggtgagcggggcctggctcgggccgccagtgaggactcgcagcccccgggcgtccgctttctcgctgggctgggtttctgcagtgccgggcgcccacccggccaccccatgagccgcgcgtctggctcttcggtggagtgagcctagaaagggcggcgttcgtccagtgatcagtgctacccgaggttgctttttgcatgactgcttgcagttaagttcaccggagtttatagttgccacaaatgtcaaaaagtagccttctggcgagctgaaagcgctcacctgtgcgctttaaggtgtaccgtctttgtctttggcgagtgtgccttttaagacgcttccaagataaa

SEQ ID NO: 124960 - DNA, 53 bp, Homo sapiens; identical to SEQ ID NO: 92950
  chr5:135364596-135364649
  Hyper

SEQ ID NO: 124961 - DNA, 1088 bp, Homo sapiens; identical to SEQ ID NO: 92951
  chr5:135527803-135528891
  Hyper

SEQ ID NO: 124962 - DNA, 1133 bp, Homo sapiens
  chr5:136834011-136835144
  Hyper
ccctccgagaggctccgcgccccccagggccgggtggcgccggtactcacgtctcgaaagcggttccagtacttgtcccggtcgtactgggagacggtgctcagccactggtcattgtctaggaaattgccgtggttggggcccgcgcctccggcgagcgcgtccaggtgccggctctcgacttggaggaagcaccacgccgcggcggccgccgccaacaccgcgatcgccggcatctgcggggcagggcgcgcagggcgatgagcgaagagggcgggcggccgcgagccccgggcacccaggcgtcccagcgccccagcccggaggcggggaccccgcggcgggcacgggcagcgctcgcgcacctggggcgcctgtcgcgcctctagacccagggacccctctcacgaatgggggactcatctacgaacgaggaggctgcgtcacgaatccgaggctgccgtccaactacaggggacccgtctcgtctattctccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctccggcaagcggggtgggggctgccagcagctgggggtccccggcgacagctaagggaaaggtctcccttgagcgccctgaggtctcgggggtaagaaaggcgcgcggaggtaaccccaggccctgaccctgccagccccctaggcggccgcggggaggtcccaactactccaagttggggcgcggggttcctctgggcacgtaccttgggggccggcccgggtcccctagtccgagttgctcgagctcccgcggcacggtcgccgggaaggctgatcgccggctcgcgcccctgcgctcctgccacacgccgccgccgagcgtctggccgctttgtgagcccgcagcgatgtgctctgctcgctcgctggctcgggcgcggcgtccgcgggcggaggaggccgagcgcgcgagccaaggctctggcgccccctggtggccgcgcgctgcctgcccgacagcccggccgccccagcccggaa

SEQ ID NO: 124963 - DNA, 99 bp, Homo sapiens
  chr5:137225068-137225167
  Hyper
gaggagctgggggctcgcgcaggcgtcagagccgggcagcgcgcgccgcaagactagcgcgcaagcgccgcggcctcaggcgaacgaacgggcggtgta

SEQ ID NO: 124964 - DNA, 30 bp, Homo sapiens; identical to SEQ ID NO: 92961
  chr5:137474889-137474919
  Hyper

SEQ ID NO: 124965 - DNA, 26 bp, Homo sapiens
  chr5:137548023-137548049
  Hypo
tttgagacagtgtcccgctctgccct

SEQ ID NO: 124966 - DNA, 412 bp, Homo sapiens; identical to SEQ ID NO: 92963
  chr5:137577572-137577984
  Hyper

SEQ ID NO: 124967 - DNA, 51 bp, Homo sapiens; identical to SEQ ID NO: 92964
  chr5:137727606-137727657
  Hypo

SEQ ID NO: 124968 - DNA, 23 bp, Homo sapiens
  chr5:137769715-137769738
  Hypo
accgtgcccgtccaacattggtg

SEQ ID NO: 124969 - DNA, 30 bp, Homo sapiens; identical to SEQ ID NO: 92967
  chr5:138060847-138060877
  Hypo

SEQ ID NO: 124970 - DNA, 122 bp, Homo sapiens; identical to SEQ ID NO: 92970
  chr5:138273634-138273756
  Hypo

SEQ ID NO: 124971 - DNA, 55 bp, Homo sapiens; identical to SEQ ID NO: 92972
  chr5:138586687-138586742
  Hypo

SEQ ID NO: 124972 - DNA, 95 bp, Homo sapiens; identical to SEQ ID NO: 92973
  chr5:138627655-138627750
  Hypo

SEQ ID NO: 124973 - DNA, 30 bp, Homo sapiens; identical to SEQ ID NO: 92974
  chr5:138670672-138670702
  Hypo

SEQ ID NO: 124974 - DNA, 143 bp, Homo sapiens; identical to SEQ ID NO: 92975
  chr5:138676299-138676442
  Hypo

SEQ ID NO: 124975 - DNA, 37 bp, Homo sapiens; identical to SEQ ID NO: 92976
  chr5:138679633-138679670
  Hypo

SEQ ID NO: 124976 - DNA, 24 bp, Homo sapiens
  chr5:138971490-138971514
  Hypo
ttgaaaacctggggccgggcgcgg

SEQ ID NO: 124977 - DNA, 309 bp, Homo sapiens; identical to SEQ ID NO: 92978
  chr5:139047939-139048248
  Hyper

SEQ ID NO: 124978 - DNA, 32 bp, Homo sapiens; identical to SEQ ID NO: 92979
  chr5:139090340-139090372
  Hyper

SEQ ID NO: 124979 - DNA, 172 bp, Homo sapiens; identical to SEQ ID NO: 92980
  chr5:139142327-139142499
  Hypo

SEQ ID NO: 124980 - DNA, 194 bp, Homo sapiens
  chr5:139144062-139144256
  Hyper
gcagcctggcgcgcccgctccctggggtccccgccgagcgcctgcctggctgcgggaccccgttgccaggagcagtcaggatgcggcagcgtctccatggcaacgcggcatctcgagccgcgcgccgccctcccccggcgccccgcagtgggcaggaggccgagcctggcagcccctcccggcccagcagccag

SEQ ID NO: 124981 - DNA, 577 bp, Homo sapiens
  chr5:139175410-139175987
  Hyper
tcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtgagtggggccgcggggctccgggacccgcccctccccgctggcggccaggccggggcgggacgggccggggagagggccgcgtgcgggtggggggcgtcgccctcgccctcggtgcccacccgggtccgctaacaaagctacatttccagatcaattccgcggcgtctggagcatccgaaggatacggttgtcatggagatggggccgagagaggaagcccgggctggccgggtctgggccggggagagggggcgccgcgggaaagcccgagcccagcctgagggacggtgggggctgccgggccgattgtctcccggctccgccacccactaccctctccccgcttttgtataatctgggggtacgcgtgtgcgtggggggtgccagtggcagcctggtggtcggggatcggggcattgggtac

SEQ ID NO: 124982 - DNA, 411 bp, Homo sapiens
  chr5:139227527-139227938
  Hyper
cccgcgggggcggcccgcggctgtgtctgctgctggcccgcgtgctgtggctgtccagtgagtagtaagtcctgctgtcggccgccgggcacagtggcggcgagtccgagcgcagcgcgtcgtgcgccccacgcaggcccaggaaaggtgtgctctcggccgccagcgccccgtccgcgtcgtccgcgtcgtcgtccgacgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactcgtcgtcctcggggatgc

SEQ ID NO: 124983 - DNA, 913 bp, Homo sapiens; identical to SEQ ID NO: 92986
  chr5:139283550-139284463
  Hyper

SEQ ID NO: 124984 - DNA, 62 bp, Homo sapiens; identical to SEQ ID NO: 92987
  chr5:139422801-139422863
  Hyper

SEQ ID NO: 124985 - DNA, 70 bp, Homo sapiens; identical to SEQ ID NO: 92988
  chr5:139492746-139492816
  Hyper

SEQ ID NO: 124986 - DNA, 391 bp, Homo sapiens; identical to SEQ ID NO: 92989
  chr5:139525423-139525814
  Hyper

SEQ ID NO: 124987 - DNA, 97 bp, Homo sapiens; identical to SEQ ID NO: 92990
  chr5:139556302-139556399
  Hypo

SEQ ID NO: 124988 - DNA, 32 bp, Homo sapiens; identical to SEQ ID NO: 92992
  chr5:139779839-139779871
  Hypo

SEQ ID NO: 124989 - DNA, 48 bp, Homo sapiens; identical to SEQ ID NO: 92994
  chr5:140011748-140011796
  Hyper

SEQ ID NO: 124990 - DNA, 369 bp, Homo sapiens
  chr5:140012151-140012520
  Hyper
ggcttccagaggcagcggaggcatggtgccggttatctttaggtcctcgagcgtcagttccttgaggcgggagtacgctagcacacgcagggcgcctaccagtagctgagcaggaacctgtgcggctcccactgtgagccgccgcacgcggagagccttgaccgtgtcagcatactgccgcgggtcggcgtccgcatcgacgcgctttagaaacggctctaggttgagaccgccggcatggatctccacctctactgcagacacacactggaaggcttcggaccagtcgggctgaggttcggagaagttgcagacgcagcggaaatcttcatcgtccagctcacaaggttctggcgtggtcgcagagac

SEQ ID NO: 124991 - DNA, 27 bp, Homo sapiens
  chr5:140045321-140045348
  Hypo
cacgcctgtaatacccgcactttggga

SEQ ID NO: 124992 - DNA, 30 bp, Homo sapiens; identical to SEQ ID NO: 92998
  chr5:140088640-140088670
  Hypo

SEQ ID NO: 124993 - DNA, 175 bp, Homo sapiens
  chr5:140174726-140174901
  Hyper
gtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttcc

SEQ ID NO: 124994 - DNA, 198 bp, Homo sapiens; identical to SEQ ID NO: 93000
  chr5:140187083-140187281
  Hyper

SEQ ID NO: 124995 - DNA, 55 bp, Homo sapiens; identical to SEQ ID NO: 93001
  chr5:140214378-140214433
  Hyper

SEQ ID NO: 124996 - DNA, 116 bp, Homo sapiens; identical to SEQ ID NO: 93002
  chr5:140248756-140248872
  Hyper

SEQ ID NO: 124997 - DNA, 142 bp, Homo sapiens; identical to SEQ ID NO: 93003
  chr5:140261869-140262011
  Hyper

SEQ ID NO: 124998 - DNA, 1705 bp, Homo sapiens
  chr5:140305402-140307107
  Hyper
tctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggcta

SEQ ID NO: 124999 - DNA, 537 bp, Homo sapiens; identical to SEQ ID NO: 93008
  chr5:140345497-140346034
  Hyper

SEQ ID NO: 125000 - DNA, 307 bp, Homo sapiens; identical to SEQ ID NO: 93009
  chr5:140346506-140346813
  Hyper

SEQ ID NO: 125001 - DNA, 30 bp, Homo sapiens; identical to SEQ ID NO: 93011
  chr5:140464113-140464143
  Hyper

SEQ ID NO: 125002 - DNA, 30 bp, Homo sapiens; identical to SEQ ID NO: 93012
  chr5:140474232-140474262
  Hyper

SEQ ID NO: 125003 - DNA, 261 bp, Homo sapiens; identical to SEQ ID NO: 93013
  chr5:140514695-140514956
  Hyper

SEQ ID NO: 125004 - DNA, 93 bp, Homo sapiens; identical to SEQ ID NO: 93014
  chr5:140581545-140581638
  Hyper

SEQ ID NO: 125005 - DNA, 182 bp, Homo sapiens; identical to SEQ ID NO: 29948
  chr5:140593316-140593498
  Hyper

SEQ ID NO: 125006 - DNA, 75 bp, Homo sapiens; identical to SEQ ID NO: 29949
  chr5:140604438-140604513
  Hyper

SEQ ID NO: 125007 - DNA, 210 bp, Homo sapiens; identical to SEQ ID NO: 93017
  chr5:140613804-140614014
  Hyper

SEQ ID NO: 125008 - DNA, 97 bp, Homo sapiens
  chr5:140614314-140614411
  Hyper
cagagtcatctttgacgactataaaccttatttgcgattggatccacagaatggcgacttgctcttaaacgagcagctggaccgggaggcactttgt

SEQ ID NO: 125009 - DNA, 23 bp, Homo sapiens
  chr5:140620855-140620878
  Hyper
caccctgttcgtccgcgagaaca

SEQ ID NO: 125010 - DNA, 70 bp, Homo sapiens
  chr5:140624988-140625058
  Hyper
cctgttagcagagcacggaccagtgtctccggagaatgctattctcctacatttccgaacaggttatcaa

SEQ ID NO: 125011 - DNA, 120 bp, Homo sapiens; identical to SEQ ID NO: 93023
  chr5:140713966-140714086
  Hyper

SEQ ID NO: 125012 - DNA, 19 bp, Homo sapiens
  chr5:140714146-140714165
  Hyper
tgggcgacagagccacacc

SEQ ID NO: 125013 - DNA, 95 bp, Homo sapiens; identical to SEQ ID NO: 93025
  chr5:140767211-140767306
  Hyper

SEQ ID NO: 125014 - DNA, 212 bp, Homo sapiens; identical to SEQ ID NO: 93026
  chr5:140777457-140777669
  Hyper

SEQ ID NO: 125015 - DNA, 85 bp, Homo sapiens; identical to SEQ ID NO: 29956
  chr5:140787848-140787933
  Hyper

SEQ ID NO: 125016 - DNA, 563 bp, Homo sapiens
  chr5:140797076-140797639
  Hyper
ttttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggag

SEQ ID NO: 125017 - DNA, 825 bp, Homo sapiens
  chr5:140800437-140801262
  Hyper
agtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcct

SEQ ID NO: 125018 - DNA, 88 bp, Homo sapiens
  chr5:140810974-140811062
  Hyper
gggggcgacccggtgcgcacaggcaccgcgcgcatccgcgtgatggttctggatgcgaacgacaacgcaccagcgtttgctcagcccg

SEQ ID NO: 125019 - DNA, 1092 bp, Homo sapiens
  chr5:140855598-140856690
  Hyper
gcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattg

SEQ ID NO: 125020 - DNA, 138 bp, Homo sapiens
  chr5:140864562-140864700
  Hyper
cagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatc

SEQ ID NO: 125021 - DNA, 60 bp, Homo sapiens
  chr5:140871515-140871575
  Hyper
acactcaaaaaaggccggggcctccttcgagcttccggtgaatttcgggcgatttccgcg

SEQ ID NO: 125022 - DNA, 30 bp, Homo sapiens; identical to SEQ ID NO: 93036
  chr5:140892846-140892876
  Hyper

SEQ ID NO: 125023 - DNA, 77 bp, Homo sapiens; identical to SEQ ID NO: 93037
  chr5:141030807-141030884
  Hyper

SEQ ID NO: 125024 - DNA, 30 bp, Homo sapiens; identical to SEQ ID NO: 93038
  chr5:141031100-141031130
  Hyper

SEQ ID NO: 125025 - DNA, 33 bp, Homo sapiens; identical to SEQ ID NO: 93040
  chr5:141255658-141255691
  Hyper

SEQ ID NO: 125026 - DNA, 605 bp, Homo sapiens
  chr5:141262718-141263323
  Hyper
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtctgccgcggcgcgggggcagcctcaccccacctcactgctggactccggagaaccatttctgggaccgggagctgtccagcgcctcgggtcctgacggaccgctgattcgcctaggtgccatcggacaagcgggtgctcagagccagctctggtggctcgggagctttcccccaaccaggctaagaccactaaaccacgcctggcccggatgagcttggatgcagctccgaacgtggggatccatcggtgctgagaactg

SEQ ID NO: 125027 - DNA, 345 bp, Homo sapiens; identical to SEQ ID NO: 93043
  chr5:141293717-141294062
  Hyper

SEQ ID NO: 125028 - DNA, 40 bp, Homo sapiens; identical to SEQ ID NO: 93044
  chr5:141302337-141302377
  Hypo

SEQ ID NO: 125029 - DNA, 30 bp, Homo sapiens; identical to SEQ ID NO: 93046
  chr5:141477290-141477320
  Hypo

SEQ ID NO: 125030 - DNA, 79 bp, Homo sapiens; identical to SEQ ID NO: 93047
  chr5:141703865-141703944
  Hyper

SEQ ID NO: 125031 - DNA, 197 bp, Homo sapiens
  chr5:141931306-141931503
  Hyper
aaatgtgctcattcccgaggaagcctcacttctccttctcgcccttaatcgctcctttcctgcccgccccagcccccaggctgggcgatttcctaaatcactcggaattggcttccagcgccggcgccccgggtgggctcccggagcgcgcgggcctgtgacccggaggtcagagatgcctccgtcctgtttgatgt

SEQ ID NO: 125032 - DNA, 95 bp, Homo sapiens; identical to SEQ ID NO: 40602
  chr5:142070580-142070675
  Hypo

SEQ ID NO: 125033 - DNA, 158 bp, Homo sapiens; identical to SEQ ID NO: 40603
  chr5:142625575-142625733
  Hypo

SEQ ID NO: 125034 - DNA, 30 bp, Homo sapiens; identical to SEQ ID NO: 93053
  chr5:142638926-142638956
  Hypo

SEQ ID NO: 125035 - DNA, 30 bp, Homo sapiens; identical to SEQ ID NO: 40604
  chr5:142689842-142689872
  Hypo

SEQ ID NO: 125036 - DNA, 30 bp, Homo sapiens; identical to SEQ ID NO: 93055
  chr5:142751146-142751176
  Hypo

SEQ ID NO: 125037 - DNA, 155 bp, Homo sapiens; identical to SEQ ID NO: 29969
  chr5:142781720-142781875
  Hyper

SEQ ID NO: 125038 - DNA, 540 bp, Homo sapiens; identical to SEQ ID NO: 93057
  chr5:142784675-142785215
  Hyper

SEQ ID NO: 125039 - DNA, 287 bp, Homo sapiens; identical to SEQ ID NO: 29971
  chr5:143584834-143585121
  Hyper

SEQ ID NO: 125040 - DNA, 289 bp, Homo sapiens; identical to SEQ ID NO: 93071
  chr5:145214863-145215152
  Hyper

SEQ ID NO: 125041 - DNA, 21 bp, Homo sapiens
  chr5:145237564-145237585
  Hypo
acggaatattcctgtcgaaaa

SEQ ID NO: 125042 - DNA, 141 bp, Homo sapiens; identical to SEQ ID NO: 93073
  chr5:145316085-145316226
  Hyper

SEQ ID NO: 125043 - DNA, 304 bp, Homo sapiens
  chr5:145713592-145713896
  Hyper
ggctgtgtccatggcggggcatctagggggaaggggagggctcctggcacgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgag

SEQ ID NO: 125044 - DNA, 557 bp, Homo sapiens
  chr5:145716880-145717437
  Hyper
attccatttaagagccgccgaaaccgaggctcagagggctttagcgaaagggttgcgcttggctctaggcacctgggctgagtctttttcccaccatcgcagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagatcgctctctcagcggaggcagtggccctgacgagggggtacagctgcacgcgcggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagttccgaaactttgagaag

SEQ ID NO: 125045 - DNA, 265 bp, Homo sapiens; identical to SEQ ID NO: 29977
  chr5:145717780-145718045
  Hyper

SEQ ID NO: 125046 - DNA, 70 bp, Homo sapiens; identical to SEQ ID NO: 93078
  chr5:145718431-145718501
  Hyper

SEQ ID NO: 125047 - DNA, 1562 bp, Homo sapiens
  chr5:145718802-145720364
  Hyper
gtggagcataattaccgctctaaggcacattttttgacaggcactagcttcatgtttttttcatgtcgcccagaacaatcgccgctgtctgaacccctctccttgtctcccccgcgttctctcccggcgcgctctctctctcattcatgtctctgatccacacgtctgttccagcagagccgctgcctccgtattaatttttatgacctgggctttgaggagaggcatctcggttgcttgaaaatgtgttttaatcctgtgttgacagtattccctactgaccgtgctgtgcgccttctcgcttgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacgacttcagagcaggagccccaaagcagaggacagtcaattggcccaaccgcccgaagctagggtgaa

SEQ ID NO: 125048 - DNA, 30 bp, Homo sapiens; identical to SEQ ID NO: 29983
  chr5:145720837-145720867
  Hyper

SEQ ID NO: 125049 - DNA, 911 bp, Homo sapiens
  chr5:145722116-145723027
  Hyper
cacatttccctgcttcgtcctcaaagagttgcgggtcatcaaaccacggggccgaaattcggagcagagtgggtttgccctccgcgcagtgcgacaccccctaccgcataagctaacttgcggatctcccccagctccctgggcctcagccctttacccccgccttgcacaacagccccagcgattcctccacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaaccgtgagcgtcccgcgccgaagcgaagcgctccagaaggacgcgcttttgcgggctgcaaggtttcctgcaggtaagaagagccttcgcatgttcgggctctggagagaaccggaaatctgcctccatcctcttttcgaaaagttctctgccgttatttatttagtctttttttttcttttaattgacaactgcaaaagtttgggagacttttacggagaggatgagaggagctgcctcctgagcgcaaggtctgctccaagacggtccagtagcactaggtccagtctccgagccatgcctctgagcctagtcttcttcaggcgcctgagacggtgatgcgcaggagtattttcaccagttcctacgtgcaggccggagctgcagcccggtcagcgaagcgctccaccctttccctcctcctgagtgcgccggaacggcgccgtcgcctcactcttcggcttgcttcaggaagcaactggagatgtggtttccccaggattgtgtagtcgcctttgccactcgtctggcggaggcacagacctctcgggggaggggaggt

SEQ ID NO: 125050 - DNA, 169 bp, Homo sapiens; identical to SEQ ID NO: 29986
  chr5:145723301-145723470
  Hyper

SEQ ID NO: 125051 - DNA, 518 bp, Homo sapiens; identical to SEQ ID NO: 93086
  chr5:145724320-145724838
  Hyper

SEQ ID NO: 125052 - DNA, 797 bp, Homo sapiens
  chr5:145725173-145725970
  Hyper
tgcctttgcttcttccgttctcaagtgagatcacctctggctggggtggggaagcggaccgcctgggagtgaaggaggagcaggtgagtccgatttggcaccagattaggcagcgcgagcagaggaggtggtgggagccgagaacgcccgctgtcctcgccgggcttcggagcctccacgcctttgtgtcccgcgcgccactcgcgtctcccgtcctgtctgtgtgcgtctgttcgcgtgtctctcactcagcccctcttagcttccctccagcctcgcgggcgcgaaactctggcccccatgtgccggagcgagggggcccgcgtccccgggcgcgcgcagagtcgccttcccctctttcctctcttccgcagagcggcgggagcccccgcggtaaccccgccccggcgggcagacggagccagcgaggaccccggcggacaaattagtctccccttcgatcgctcttttccgatcaagtcaggtttcccctgttcccccgacggcgcttccgcactagcgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgccactggaggcaaactgggacagaaactgcgctcgctctctttt

SEQ ID NO: 125053 - DNA, 1555 bp, Homo sapiens
  chr5:146256927-146258482
  Hyper
ttttaaaggccccaccgatcgcgttgctcaccccacgtgtcagcctcattcgctgcccgccagagcactatttccccagccacctttttatttttgctaatgcacttccaaaaggaaagaggttcgcccgtctgcaaagggctttttggggttttgattgtctaagcaggtaacctggccggccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgcgaggtgcactggggctgccggggccagccgagcccccgccccagccctagggcccggaggagtctccgccactacgcgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagcagcagtggtggccgaggcagaggctgcggctgctctttgctgcagtggggcgcatgcagccgcgaatcggcacctgggcagc

SEQ ID NO: 125054 - DNA, 375 bp, Homo sapiens; identical to SEQ ID NO: 93091
  chr5:146614106-146614481
  Hyper

SEQ ID NO: 125055 - DNA, 65 bp, Homo sapiens; identical to SEQ ID NO: 93092
  chr5:146614703-146614768
  Hyper

SEQ ID NO: 125056 - DNA, 36 bp, Homo sapiens; identical to SEQ ID NO: 29996
  chr5:146832654-146832690
  Hyper

SEQ ID NO: 125057 - DNA, 158 bp, Homo sapiens; identical to SEQ ID NO: 93094
  chr5:146833012-146833170
  Hyper

SEQ ID NO: 125058 - DNA, 106 bp, Homo sapiens; identical to SEQ ID NO: 93095
  chr5:146833649-146833755
  Hyper

SEQ ID NO: 125059 - DNA, 1031 bp, Homo sapiens
  chr5:146888811-146889842
  Hyper
cccgggcatcccttccgcgcttgcacgaagatgctgcaagtggcgacacgcgcgaatccagggtctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcccgggccgactccccgatcctcggtcgctgccctggccgctccgaggagtcttcgcgccccgctgccccacgctgagggcatcgaaatccagcgtcttgctctcgaaggcgccctccacgttgcagaacatgccgccgtatttctgccgcgggacctggtccgtggtgcccggcctggccaggtacacgggcagatcgtcttcgtgggagctgtcccagcccctccggcccgaggccatggttcaagcacgaaagcggcccgcgggtttttcttccccagaggcggaaagggcagccgccggcagcgtgcgccgagccacagtgactgtggcgggaggaggcgcctgagccttcgcgccagaggcggcagtgctgctccgattcctgcttgtccctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcctcacacactttcgcgcaatttagacgtc

SEQ ID NO: 125060 - DNA, 332 bp, Homo sapiens
  chr5:148033722-148034054
  Hyper
cccagccgctgcctgcgccctccctgccgccccctcgggtgcgggctccagcccccgcgctggggagccggcgagcgtgaggcgcgggccaggggctgcgggcgcaggaccccagccccggatcacctgggctcgccgcgcatcgtccttctccccaaccgagccggactccacgggctcaacagcccccagccccggtggtccccgctgccctgcccgctgccgcccccactgggcgccagggacagcgggggtgccgctctgccggcagggcgcacaggggagtgggcacagaggcgggctggagcgatctcacccgttccgggctggcc

SEQ ID NO: 125061 - DNA, 49 bp, Homo sapiens; identical to SEQ ID NO: 93109
  chr5:148205651-148205700
  Hyper

SEQ ID NO: 125062 - DNA, 247 bp, Homo sapiens; identical to SEQ ID NO: 93110
  chr5:148206185-148206432
  Hyper

SEQ ID NO: 125063 - DNA, 272 bp, Homo sapiens; identical to SEQ ID NO: 30002
  chr5:148521059-148521331
  Hyper

SEQ ID NO: 125064 - DNA, 964 bp, Homo sapiens; identical to SEQ ID NO: 93112
  chr5:148651223-148652187
  Hyper

SEQ ID NO: 125065 - DNA, 18 bp, Homo sapiens
  chr5:148872640-148872658
  Hypo
ttgttgttgttgagacgg

SEQ ID NO: 125066 - DNA, 25 bp, Homo sapiens
  chr5:148928401-148928426
  Hypo
gcgaaaactccgtcttaaagaagag

SEQ ID NO: 125067 - DNA, 63 bp, Homo sapiens; identical to SEQ ID NO: 93117
  chr5:149005075-149005138
  Hypo

SEQ ID NO: 125068 - DNA, 149 bp, Homo sapiens; identical to SEQ ID NO: 40606
  chr5:149014648-149014797
  Hypo

SEQ ID NO: 125069 - DNA, 240 bp, Homo sapiens; identical to SEQ ID NO: 93119
  chr5:149311635-149311875
  Hypo

SEQ ID NO: 125070 - DNA, 90 bp, Homo sapiens
  chr5:149546573-149546663
  Hyper
ctccagctactctcacgtggagccggcccccgcgcccccgacggcctggggggcgcccttccctgcgcccaaggacgactgggccgccgc

SEQ ID NO: 125071 - DNA, 154 bp, Homo sapiens; identical to SEQ ID NO: 93122
  chr5:149547723-149547877
  Hypo

SEQ ID NO: 125072 - DNA, 401 bp, Homo sapiens; identical to SEQ ID NO: 93123
  chr5:149569485-149569886
  Hyper

SEQ ID NO: 125073 - DNA, 30 bp, Homo sapiens; identical to SEQ ID NO: 40607
  chr5:149624264-149624294
  Hypo

SEQ ID NO: 125074 - DNA, 34 bp, Homo sapiens; identical to SEQ ID NO: 93126
  chr5:149681755-149681789
  Hyper

SEQ ID NO: 125075 - DNA, 682 bp, Homo sapiens; identical to SEQ ID NO: 93127
  chr5:149682009-149682691
  Hyper

SEQ ID NO: 125076 - DNA, 211 bp, Homo sapiens; identical to SEQ ID NO: 93128
  chr5:149810703-149810914
  Hypo

SEQ ID NO: 125077 - DNA, 734 bp, Homo sapiens; identical to SEQ ID NO: 30008
  chr5:150051058-150051792
  Hyper

SEQ ID NO: 125078 - DNA, 76 bp, Homo sapiens; identical to SEQ ID NO: 93130
  chr5:150052035-150052111
  Hyper

SEQ ID NO: 125079 - DNA, 232 bp, Homo sapiens
  chr5:150158219-150158451
  Hyper
tccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgcca

SEQ ID NO: 125080 - DNA, 696 bp, Homo sapiens; identical to SEQ ID NO: 93132
  chr5:150399922-150400618
  Hyper

SEQ ID NO: 125081 - DNA, 104 bp, Homo sapiens; identical to SEQ ID NO: 93133
  chr5:150537549-150537653
  Hyper

SEQ ID NO: 125082 - DNA, 30 bp, Homo sapiens; identical to SEQ ID NO: 93134
  chr5:150577129-150577159
  Hypo

SEQ ID NO: 125083 - DNA, 30 bp, Homo sapiens; identical to SEQ ID NO: 93135
  chr5:150829685-150829715
  Hypo

SEQ ID NO: 125084 - DNA, 60 bp, Homo sapiens; identical to SEQ ID NO: 93136
  chr5:150901687-150901747
  Hypo

SEQ ID NO: 125085 - DNA, 177 bp, Homo sapiens; identical to SEQ ID NO: 93137
  chr5:150911205-150911382
  Hypo

SEQ ID NO: 125086 - DNA, 248 bp, Homo sapiens; identical to SEQ ID NO: 93138
  chr5:151066252-151066500
  Hyper

SEQ ID NO: 125087 - DNA, 118 bp, Homo sapiens; identical to SEQ ID NO: 93139
  chr5:151150563-151150681
  Hyper

SEQ ID NO: 125088 - DNA, 28 bp, Homo sapiens
  chr5:151251400-151251428
  Hypo
aggcgtgaaccaccgcgcccggccgtga

SEQ ID NO: 125089 - DNA, 542 bp, Homo sapiens
  chr5:151304211-151304753
  Hyper
gatgttaaagggaggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttgacggcgctgccttcagttaaatctcggagagtgtgccaggctggcgcatcgcaatccagtctcggaatctcgttctcctgcctctgtgcgggtctgctgtcgccttgctattcct

SEQ ID NO: 125090 - DNA, 42 bp, Homo sapiens; identical to SEQ ID NO: 93143
  chr5:151383718-151383760
  Hypo

SEQ ID NO: 125091 - DNA, 130 bp, Homo sapiens; identical to SEQ ID NO: 93144
  chr5:151784174-151784304
  Hypo

SEQ ID NO: 125092 - DNA, 30 bp, Homo sapiens; identical to SEQ ID NO: 93145
  chr5:152760944-152760974
  Hypo

SEQ ID NO: 125093 - DNA, 214 bp, Homo sapiens; identical to SEQ ID NO: 93146
  chr5:152870105-152870319
  Hyper

SEQ ID NO: 125094 - DNA, 33 bp, Homo sapiens; identical to SEQ ID NO: 93148
  chr5:152979673-152979706
  Hypo

SEQ ID NO: 125095 - DNA, 21 bp, Homo sapiens
  chr5:153118296-153118317
  Hypo
ttggagaaggcatttcgctct

SEQ ID NO: 125096 - DNA, 188 bp, Homo sapiens; identical to SEQ ID NO: 93150
  chr5:153131278-153131466
  Hypo

SEQ ID NO: 125097 - DNA, 160 bp, Homo sapiens; identical to SEQ ID NO: 93151
  chr5:153558736-153558896
  Hypo

SEQ ID NO: 125098 - DNA, 47 bp, Homo sapiens; identical to SEQ ID NO: 93152
  chr5:153569225-153569272
  Hyper

SEQ ID NO: 125099 - DNA, 93 bp, Homo sapiens; identical to SEQ ID NO: 93153
  chr5:153785959-153786052
  Hypo

SEQ ID NO: 125100 - DNA, 1111 bp, Homo sapiens
  chr5:153852408-153853519
  Hyper
gccgttctctgtgctcggcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgccagacttggctttggcggccgctggcgggtctccctcagcaccccctcttctttccccggctataagaaagctagaccagggtgcgcattcttcccgtgcctaggatacttcacggtgctaaaaatagtcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgctacggtgtttacagccaagactaatggggtcccatattcaccccgacgctgggacaaggcgcctggggcacgcctggtgccccacgaggccctgccccggagctgcctgaggtctcctttcttgttcccaagccgagcgctcaggctccaggtgcgcagagcgaaagttccaagacagcctcacgggtctcccctcctccttcgcagtgagcgccgc

SEQ ID NO: 125101 - DNA, 30 bp, Homo sapiens; identical to SEQ ID NO: 93156
  chr5:153854871-153854901
  Hyper

SEQ ID NO: 125102 - DNA, 2706 bp, Homo sapiens
  chr5:153855175-153857881
  Hyper
tcaaaggacattgcacgtgcgatccaagtgtgtggttgcagccgacgacctgccggcgctcagcagaagctccgcgggatgcgtagcaccagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtgcgtcctttaatcctcttctcgactgggcccagggcaggaggaaaaccttcgtgctgctgctgccaaaggacacacagaagaaaagaggcgggagagacaggttttaatttttctgctccgatcgcccggcatggggtaagatgaggaggaggggaaggtgtcgggagcagtaactgggagtctttaaataagtgacggatttctgtttgcgaaataggcaaacaggctcgtaaatttgcctttatgcgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcaccccacacacttccgccagcctcccaacctggtttaaacatcagggcttggatgcaggcttggggccccctaagccggagctgggagcctcagatacggaggtaaaagagcggggagtcgagctggcctagcgtcctccttcccgctctttcagcaggaaccaagcggtgctacttgaaggaggcggcgacgcgtgggggccgggatccgcccaataacaacttctttcgaggcgccgcacctcgaaagaagccggcctgcaccatccccagtccggggcagccgtttagagactcgatgcctatttatctttccctcgtccctggatgagctttcgtcagtttaccacaggcccccgcaggttggataaaccaggtggggcgcttcagctggctccactccgctacggccttaagccccccaacctagagaaactgattggccagcctgaaaacccagcgctcagaagcccccagccccggacagccagaccgagtgccaggaagtgtcaccctaaccggagaggatcaagaaggccaagacgagactgcgctctccaaagctaaaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattcaaactcaaagtaaagaactttaacacatattcttaacctggcttccaggagagcccaggaatgaatcaggacttctccaaattggaagcaaaacctgtggtgtgtgcatttttggagggtccgaggctccaaacagattattcactcagtattacaaacactctcccgtattacaaatgaattctatgacgaatctgcctccctccatgcacaggatcgcacgctgtgaccaaccatctcagaactcttcccaacctttccaaatcggacacaggacaacacagcctccttcgactacctgcatggcctgaggctgctcaccgctcctgcacccttggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggcacgttggggatgcactcgcgcaactccgcgaatgcgctgttaatgctctcagtgcgtctccgctccttcttgggtcctgagcctttccgccggccaagacggccgccaagcgcctccagccgcccggggctctgcccaggcctggcgtcaggaccataggcggtggcggctgcagcggccgcgggcggcggcccgcccgcagggaagtccggggcagcgtcagccgggctcagcagccagctctggaagtagggcctttcctgatgacagcgcgaggccggaccgaagaggaagggttcgtggagcatggggtgcgcagggtgcgggtggtgatggtggtgatggtgtgcgtagctgcccacgaggttcatgttggagcggctactggcctgcgccgccagccctattaacgccgctccatgcgccccagagactgccgggggccacctgtgggctctggagccactactgggcgccggctttgggagagtccgggcaaggctgaaaatgagacgcgcagcccactgtcttcttaccggtttctgccgcgggcgaggtcgccgaagcccaaagacctgtttaacccttctgcggactcccctgcggatctggcttatataagaccgcggctttgatgtcaacctctcccgggagccaatggcaggggggcggggataaggaaaa

SEQ ID NO: 125103 - DNA, 1689 bp, Homo sapiens
  chr5:153858119-153859808
  Hyper
tccagaatcaccaagcgaaaagaaggcctacacctagagcccgccttttgattttacagacaaggaaactgaggcccagggaaagaaaggttcttgtttctagactgtctagaagtctaaataggaattccagcagttcccagtcccgagctccaactgctctgctcggcgtcagagctagaagatgagagggcgctgctgaagacaggataggccgctaacgttcttccctaacaccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtaggggtggggcgggaaggaggaggcggactccaggcccacgggcatcgacgggtttgttcccggcttgagggtctgagatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccgcgaggctcgcacaggcaaacgcgacgtccggcatctctcacgcatcagcgcagaggcgcgactcggctgcacgaccctccgagatttcaccccgggggtagggccattccctgccagccggactctctccactgtgggctttccccaggctcgcgttggaatctgggaatcccggagtggtgacgcttcaagctggggactctcggtcttacctcccgctgtggttcctttcttggccgatgtccacctacctgggtccctcattctctcaacctttctcagctcaacgccccctccctcggtgtggtagagggagtgtgcctctcttcaaagcaaagtcgaggggagggggaaaggagaagttaatgtgagtgctctttttagaaggcaaatcattcacccattcattcaacaattatttattgatgcctactatgtgcctatcatagttactagtccaaagacagagggagaaaggcccattctctccttgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgctggggtagggcagagcgcggagccggaggcacgcggggagggagcgctgggggcccgctgctgcggcggctctgcggggtcccaagcctccctggcctggaggcattctagaaagagcgcaggtagagagta

SEQ ID NO: 125104 - DNA, 540 bp, Homo sapiens
  chr5:153862037-153862577
  Hyper
taggacagctgtacccgggcaatgcgaaggtccctcaagcctggacgttctgcagtggtggggtctcgctcttgccctagcccctctcctaccctcacccctatccgcgccccccggactggcaggcctctggaagcccaggccgcggcgcctaccgcaaaaccttctcccgccgcagtcccgtgaccttgacgccacgggcaatccccgcaccggaccccttatctaaatagggcagtaaatcaaggacctgtcagggcccgggtaattacaggaactccataaaaaggacccggccggccgcctgtttatattagcgcggtgtaaaatattctcgctgtcttggggaatcgcgtcgcgcagtaacgcgccataaatcagcccgcggaccatttaccccgcagcttgagcgcgcaaatcccttaaacatttctctgccatgtctgaagaggacctaggactttccaatctggcccagcctgctcccagggatgggggacagtcggggcagggaagagataggcacggagtagattgctc

SEQ ID NO: 125105 - DNA, 277 bp, Homo sapiens
  chr5:153863373-153863650
  Hyper
cctctgtgtattttccgcacagagagatgtctgcttcgggacgcgttcaacctaaacagaacccggtctgattggaaaatgtatttatttgaaaaatcgtaactcacggttttggtgaaaacggcccccaaatttatgggatcgcttggggcgcagcgattgtaaatcaaaaggcactggacacctccctcccccatccccgaagcagctcggtcaggttctccagaacaccaggagtcctgtctcctcccggtccaccctgcggccctccgagacc

SEQ ID NO: 125106 - DNA, 30 bp, Homo sapiens; identical to SEQ ID NO: 30029
  chr5:153863972-153864002
  Hyper

SEQ ID NO: 125107 - DNA, 30 bp, Homo sapiens; identical to SEQ ID NO: 93168
  chr5:153900800-153900830
  Hyper

SEQ ID NO: 125108 - DNA, 530 bp, Homo sapiens; identical to SEQ ID NO: 93169
  chr5:153990744-153991274
  Hyper

SEQ ID NO: 125109 - DNA, 78 bp, Homo sapiens; identical to SEQ ID NO: 93170
  chr5:154071660-154071738
  Hypo

SEQ ID NO: 125110 - DNA, 254 bp, Homo sapiens; identical to SEQ ID NO: 40613
  chr5:154209733-154209987
  Hypo

SEQ ID NO: 125111 - DNA, 101 bp, Homo sapiens; identical to SEQ ID NO: 93172
  chr5:154318077-154318178
  Hypo

SEQ ID NO: 125112 - DNA, 16 bp, Homo sapiens
  chr5:154376080-154376096
  Hypo
agaattaagactgggc

SEQ ID NO: 125113 - DNA, 30 bp, Homo sapiens; identical to SEQ ID NO: 93174
  chr5:154393651-154393681
  Hypo

SEQ ID NO: 125114 - DNA, 33 bp, Homo sapiens; identical to SEQ ID NO: 93175
  chr5:154398961-154398994
  Hypo

SEQ ID NO: 125115 - DNA, 520 bp, Homo sapiens; identical to SEQ ID NO: 93182
  chr5:155107388-155107908
  Hyper

SEQ ID NO: 125116 - DNA, 717 bp, Homo sapiens
  chr5:155108132-155108849
  Hyper
agcgcgatgctgcttcgcttcttctaggcggcggccggcggaggctttccgcagccgcttggccggcgccggcccctattccgttggcaagtcccttgtctatcccggagggcgcacccggacgctcgagccggagcgagcgcgaagtccgaagtccgcccccagagccgccaacttccctgtgagcccctctccccgccgcagcctgcgccagacctgggagcgatgcgcccccacccgggcggcgcgccctctgccaactcgccacccatgggatcgactgccctcagctgcccggcttggagtgcgtagccttcgccgcgtggcccaggagaggagcgagacaccaaggcgtttcgcggactccgcgcgcaccagtcggcttggtggccctgcgggatagcgtttatacccaggggtgagtaggccgctaatggaggccccctttacccccagctagcggcttgcatggacggcaaagagacgggagaaagttgggtctccttgcgcttaatctggcattggcagaggaatgcaacactgtttcctccaactcgattgccgcgggggtttccccagttccctccatctctaagccaaggagggagtccccttccgcttcctaaggagaaaaggggctccctagagcagatcgctgacttcctcaccaacgtgccatttggggcttttcagccgcccgcgcgttaagctagctcc

SEQ ID NO: 125117 - DNA, 384 bp, Homo sapiens
  chr5:155109115-155109499
  Hyper
atccgcggtgcggtgcgggttttaggggcgcacaatacagggtgtccagacagagtccaacaggtggcctgcgcgggcatcctgtggctaggcgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtcctcggacttgagccatggccttccccacgatccctggcggcagtatcccagc

SEQ ID NO: 125118 - DNA, 21 bp, Homo sapiens
  chr5:156384996-156385017
  Hypo
agatctggccgggcgcggtgg

SEQ ID NO: 125119 - DNA, 183 bp, Homo sapiens; identical to SEQ ID NO: 93188
  chr5:156472913-156473096
  Hypo

SEQ ID NO: 125120 - DNA, 30 bp, Homo sapiens; identical to SEQ ID NO: 93189
  chr5:156522857-156522887
  Hypo

SEQ ID NO: 125121 - DNA, 38 bp, Homo sapiens; identical to SEQ ID NO: 93190
  chr5:156591428-156591466
  Hypo

SEQ ID NO: 125122 - DNA, 30 bp, Homo sapiens; identical to SEQ ID NO: 93191
  chr5:156672960-156672990
  Hypo

SEQ ID NO: 125123 - DNA, 584 bp, Homo sapiens; identical to SEQ ID NO: 93192
  chr5:156874096-156874680
  Hypo

SEQ ID NO: 125124 - DNA, 455 bp, Homo sapiens; identical to SEQ ID NO: 30035
  chr5:156887049-156887504
  Hyper

SEQ ID NO: 125125 - DNA, 30 bp, Homo sapiens; identical to SEQ ID NO: 93194
  chr5:156960564-156960594
  Hypo

SEQ ID NO: 125126 - DNA, 132 bp, Homo sapiens; identical to SEQ ID NO: 93195
  chr5:157001726-157001858
  Hyper

SEQ ID NO: 125127 - DNA, 106 bp, Homo sapiens; identical to SEQ ID NO: 93196
  chr5:157002098-157002204
  Hyper

SEQ ID NO: 125128 - DNA, 370 bp, Homo sapiens; identical to SEQ ID NO: 93197
  chr5:157002447-157002817
  Hyper

SEQ ID NO: 125129 - DNA, 143 bp, Homo sapiens; identical to SEQ ID NO: 93198
  chr5:157041326-157041469
  Hypo

SEQ ID NO: 125130 - DNA, 42 bp, Homo sapiens; identical to SEQ ID NO: 93199
  chr5:157078407-157078449
  Hypo

SEQ ID NO: 125131 - DNA, 469 bp, Homo sapiens; identical to SEQ ID NO: 93200
  chr5:157098271-157098740
  Hyper

SEQ ID NO: 125132 - DNA, 135 bp, Homo sapiens; identical to SEQ ID NO: 93201
  chr5:157852959-157853094
  Hypo

SEQ ID NO: 125133 - DNA, 18 bp, Homo sapiens
  chr5:157881508-157881526
  Hypo
tggagcagaaaggggcgg

SEQ ID NO: 125134 - DNA, 66 bp, Homo sapiens; identical to SEQ ID NO: 93203
  chr5:158139390-158139456
  Hypo

SEQ ID NO: 125135 - DNA, 30 bp, Homo sapiens; identical to SEQ ID NO: 93204
  chr5:158250354-158250384
  Hypo

SEQ ID NO: 125136 - DNA, 30 bp, Homo sapiens; identical to SEQ ID NO: 93205
  chr5:158398433-158398463
  Hypo

SEQ ID NO: 125137 - DNA, 374 bp, Homo sapiens
  chr5:158478441-158478815
  Hyper
cccacccccccaccccgccgcccggcggctgacggctcccgctccacatgtgcgactcgtgtttcggctttcgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtgcacaatcacaatcgcagccagcagttt

SEQ ID NO: 125138 - DNA, 123 bp, Homo sapiens
  chr5:158524625-158524748
  Hyper
agctctggccaactgcgagtgcccggccttgggaagccacatccccccaccaccaaaaagcatgtggagaagggtccgagggcggggctcagaactgtcgcgggtggtcgctgtgaaaaaggg

SEQ ID NO: 125139 - DNA, 289 bp, Homo sapiens; identical to SEQ ID NO: 30043
  chr5:158526129-158526418
  Hyper

SEQ ID NO: 125140 - DNA, 754 bp, Homo sapiens
  chr5:158527373-158528127
  Hyper
gcggggcccgcgcatcgaggccccgccccttcatttgcataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagcccgggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcgggcagtcctcgag

SEQ ID NO: 125141 - DNA, 246 bp, Homo sapiens; identical to SEQ ID NO: 93212
  chr5:158533542-158533788
  Hyper

SEQ ID NO: 125142 - DNA, 141 bp, Homo sapiens; identical to SEQ ID NO: 93213
  chr5:158612852-158612993
  Hypo

SEQ ID NO: 125143 - DNA, 189 bp, Homo sapiens; identical to SEQ ID NO: 93214
  chr5:158875177-158875366
  Hypo

SEQ ID NO: 125144 - DNA, 324 bp, Homo sapiens; identical to SEQ ID NO: 93215
  chr5:159200128-159200452
  Hyper

SEQ ID NO: 125145 - DNA, 261 bp, Homo sapiens; identical to SEQ ID NO: 93217
  chr5:159343387-159343648
  Hyper

SEQ ID NO: 125146 - DNA, 644 bp, Homo sapiens
  chr5:159399066-159399710
  Hyper
ccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccgagcatgctgagag

SEQ ID NO: 125147 - DNA, 27 bp, Homo sapiens
  chr5:159437321-159437348
  Hypo
cagttaaaatgacgatttgacattatt

SEQ ID NO: 125148 - DNA, 376 bp, Homo sapiens; identical to SEQ ID NO: 93221
  chr5:159615222-159615598
  Hyper

SEQ ID NO: 125149 - DNA, 21 bp, Homo sapiens
  chr5:159660593-159660614
  Hypo
gaaactggccgggcacggtgg

SEQ ID NO: 125150 - DNA, 28 bp, Homo sapiens
  chr5:159672080-159672108
  Hypo
ggtaggggctgggtgcggtggctcacgc

SEQ ID NO: 125151 - DNA, 56 bp, Homo sapiens; identical to SEQ ID NO: 93224
  chr5:159738684-159738740
  Hyper

SEQ ID NO: 125152 - DNA, 137 bp, Homo sapiens; identical to SEQ ID NO: 93225
  chr5:159739049-159739186
  Hyper

SEQ ID NO: 125153 - DNA, 468 bp, Homo sapiens; identical to SEQ ID NO: 93226
  chr5:159739433-159739901
  Hyper

SEQ ID NO: 125154 - DNA, 262 bp, Homo sapiens; identical to SEQ ID NO: 93227
  chr5:159776326-159776588
  Hypo

SEQ ID NO: 125155 - DNA, 40 bp, Homo sapiens; identical to SEQ ID NO: 93229
  chr5:160498377-160498417
  Hypo

SEQ ID NO: 125156 - DNA, 425 bp, Homo sapiens; identical to SEQ ID NO: 93230
  chr5:160973379-160973804
  Hyper

SEQ ID NO: 125157 - DNA, 249 bp, Homo sapiens; identical to SEQ ID NO: 30056
  chr5:160974612-160974861
  Hyper

SEQ ID NO: 125158 - DNA, 377 bp, Homo sapiens
  chr5:160975071-160975448
  Hyper
ggcactgtgttctcccgcggtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggccgtccgaaggaaccggagtccacaccagcggctctccgggtactcctgagtttatcttggaactggggaagaggcgggaagagtagacgttcccgctacccc

SEQ ID NO: 125159 - DNA, 330 bp, Homo sapiens
  chr5:160975668-160975998
  Hyper
tgaagtcaagaagctcgcccaaggtcactcagatggcatgaggtgaaaccaggattggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcccgcagagttggcggcaggcggcggaagtagctccacaggcttgcgaccccggcagccctggggg

SEQ ID NO: 125160 - DNA, 37 bp, Homo sapiens; identical to SEQ ID NO: 93236
  chr5:161274219-161274256
  Hyper

SEQ ID NO: 125161 - DNA, 160 bp, Homo sapiens
  chr5:161274605-161274765
  Hyper
ctctttcctaccatccgtcaccattcgtgactctgcaagacacggggacttagacatatgtgtgggagtgtgtgtgtgagggagagaggcgagacgagtgctctccccacacgtgtaaccctgcatctcccagtttcagagcttgcgttcattcatatgc

SEQ ID NO: 125162 - DNA, 287 bp, Homo sapiens
  chr5:161275303-161275590
  Hyper
gcccctctgctctggcgcgcccggactcggactcgcagactcgcgctggctccagtctctccacgattctctctcccagacttttccccggtcttaagagatcctgtgtccagagggggccttaggtaagtgcgactttggaccacgatacacagacagagctttgaacgtggcttttcctagctggagagacaggaatgttatagtcggggggggggggcggggggagacggggggagagagagagagagagaagaaggagagcgagcgagcgagcaagggagcga

SEQ ID NO: 125163 - DNA, 58 bp, Homo sapiens; identical to SEQ ID NO: 93239
  chr5:161275813-161275871
  Hyper

SEQ ID NO: 125164 - DNA, 76 bp, Homo sapiens; identical to SEQ ID NO: 93240
  chr5:161495120-161495196
  Hyper

SEQ ID NO: 125165 - DNA, 30 bp, Homo sapiens; identical to SEQ ID NO: 93247
  chr5:162807006-162807036
  Hypo

SEQ ID NO: 125166 - DNA, 46 bp, Homo sapiens; identical to SEQ ID NO: 93248
  chr5:162930274-162930320
  Hyper

SEQ ID NO: 125167 - DNA, 805 bp, Homo sapiens; identical to SEQ ID NO: 93249
  chr5:162931152-162931957
  Hyper

SEQ ID NO: 125168 - DNA, 45 bp, Homo sapiens; identical to SEQ ID NO: 93250
  chr5:163604915-163604960
  Hypo

SEQ ID NO: 125169 - DNA, 149 bp, Homo sapiens; identical to SEQ ID NO: 93251
  chr5:164218749-164218898
  Hypo

SEQ ID NO: 125170 - DNA, 55 bp, Homo sapiens; identical to SEQ ID NO: 93254
  chr5:165029934-165029989
  Hypo

SEQ ID NO: 125171 - DNA, 28 bp, Homo sapiens
  chr5:166269144-166269172
  Hypo
atctgagtcggccagcgcggtggctcac

SEQ ID NO: 125172 - DNA, 89 bp, Homo sapiens; identical to SEQ ID NO: 93258
  chr5:166363557-166363646
  Hypo

SEQ ID NO: 125173 - DNA, 1007 bp, Homo sapiens; identical to SEQ ID NO: 93259
  chr5:166405469-166406476
  Hyper

SEQ ID NO: 125174 - DNA, 151 bp, Homo sapiens; identical to SEQ ID NO: 93260
  chr5:166461205-166461356
  Hypo

SEQ ID NO: 125175 - DNA, 43 bp, Homo sapiens; identical to SEQ ID NO: 93261
  chr5:166470722-166470765
  Hypo

SEQ ID NO: 125176 - DNA, 83 bp, Homo sapiens; identical to SEQ ID NO: 93262
  chr5:166532947-166533030
  Hypo

SEQ ID NO: 125177 - DNA, 21 bp, Homo sapiens
  chr5:166865441-166865462
  Hypo
gctggagtgcagtggcgccat

SEQ ID NO: 125178 - DNA, 30 bp, Homo sapiens; identical to SEQ ID NO: 93267
  chr5:166920753-166920783
  Hypo

SEQ ID NO: 125179 - DNA, 239 bp, Homo sapiens; identical to SEQ ID NO: 93268
  chr5:167000910-167001149
  Hyper

SEQ ID NO: 125180 - DNA, 30 bp, Homo sapiens; identical to SEQ ID NO: 93271
  chr5:167449482-167449512
  Hypo

SEQ ID NO: 125181 - DNA, 30 bp, Homo sapiens; identical to SEQ ID NO: 93272
  chr5:167530477-167530507
  Hypo

SEQ ID NO: 125182 - DNA, 99 bp, Homo sapiens; identical to SEQ ID NO: 93273
  chr5:167689244-167689343
  Hypo

SEQ ID NO: 125183 - DNA, 497 bp, Homo sapiens
  chr5:167955981-167956478
  Hyper
gcatagactagacttcgaggatgaacatgacattttggctctctgtgtatccccattcacactgaagaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttccgggccgcagggtcgcggggacgggtgtgatgcaatcgcgccacagccgctgcgtcaaggggcggctccgggatgcgggcactgcggtagagcccgtcctgcccccgccgcccgccgcccgccgcccgcctccgctgctaaacccgcggacaaccgccgggacgaccacccagagccaccagagccccctgacacccgccccgaggcaccg

SEQ ID NO: 125184 - DNA, 313 bp, Homo sapiens
  chr5:167956683-167956996
  Hyper
gggggcggccggggccgggggcgcggcggcggcgacggcaaggatcgcggcggcggtggacagcggcggggcggcgtggccaagagcaagagccgccgcaggaagggcgccatggtggtgtcggtggagccgcaccggcacgagggcgtcttcatctaccgcggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcg

SEQ ID NO: 125185 - DNA, 166 bp, Homo sapiens; identical to SEQ ID NO: 93279
  chr5:168192155-168192321
  Hypo

SEQ ID NO: 125186 - DNA, 190 bp, Homo sapiens; identical to SEQ ID NO: 93280
  chr5:168195076-168195266
  Hypo

SEQ ID NO: 125187 - DNA, 57 bp, Homo sapiens; identical to SEQ ID NO: 93281
  chr5:168231749-168231806
  Hypo

SEQ ID NO: 125188 - DNA, 197 bp, Homo sapiens; identical to SEQ ID NO: 93282
  chr5:168233348-168233545
  Hypo

SEQ ID NO: 125189 - DNA, 30 bp, Homo sapiens; identical to SEQ ID NO: 93283
  chr5:168244450-168244480
  Hypo

SEQ ID NO: 125190 - DNA, 30 bp, Homo sapiens; identical to SEQ ID NO: 93284
  chr5:168250255-168250285
  Hypo

SEQ ID NO: 125191 - DNA, 74 bp, Homo sapiens; identical to SEQ ID NO: 93285
  chr5:168253292-168253366
  Hypo

SEQ ID NO: 125192 - DNA, 30 bp, Homo sapiens; identical to SEQ ID NO: 93286
  chr5:168258418-168258448
  Hypo

SEQ ID NO: 125193 - DNA, 278 bp, Homo sapiens; identical to SEQ ID NO: 93287
  chr5:168267858-168268136
  Hypo

SEQ ID NO: 125194 - DNA, 24 bp, Homo sapiens
  chr5:168278312-168278336
  Hypo
gtgagactccgtctcaaaaaaaaa

SEQ ID NO: 125195 - DNA, 43 bp, Homo sapiens; identical to SEQ ID NO: 93289
  chr5:168289177-168289220
  Hypo

SEQ ID NO: 125196 - DNA, 92 bp, Homo sapiens; identical to SEQ ID NO: 93290
  chr5:168337394-168337486
  Hypo

SEQ ID NO: 125197 - DNA, 114 bp, Homo sapiens; identical to SEQ ID NO: 93291
  chr5:168372951-168373065
  Hypo

SEQ ID NO: 125198 - DNA, 22 bp, Homo sapiens
  chr5:168614854-168614876
  Hypo
gctgcaacgataaattcttaaa

SEQ ID NO: 125199 - DNA, 998 bp, Homo sapiens
  chr5:168727355-168728353
  Hyper
tacagacccccagctcggagagtgagggatcgtatccaggaagggatgagaatagagactgcatccagggaggccgaggggaaaggacggatctggcgcctggggccccctcggtgggacccaggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggccggcgctgccccgctgcgcatcgctgggagtgcccaggtgcggagcgccccctggccccgctggcccgcgggccgggttggggacctggggcgagcgcaatggggcgtggcgcccggggaggtccggcttggggctgggctggggagcgcggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgactaagttgggaactttgctggagcgaccgagagcctggagggaggaggcagtagaggagggagagagaaggaaccagggaaggaaaggggctcggccagcagggccc

SEQ ID NO: 125200 - DNA, 41 bp, Homo sapiens; identical to SEQ ID NO: 93296
  chr5:168728570-168728611
  Hyper

SEQ ID NO: 125201 - DNA, 30 bp, Homo sapiens; identical to SEQ ID NO: 93297
  chr5:168771979-168772009
  Hypo

SEQ ID NO: 125202 - DNA, 797 bp, Homo sapiens
  chr5:169064008-169064805
  Hyper
aactctctgcacttgcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagccgaggctcggggagaggacggcgggaccccaccccgcaggctaagcacagccctcgccctctcgcctgctgagggaaccttagacatttccgagatagggtcaagacctgcgcttgacaactcagttcttcgcgccaaactcggcgtccccaggagtgccccagctcgccgcgtgggagacttggccttgtagagggagctccactctcccctggctcagccttggcctgcccaccatgcatacttccaccccctccaaagcgacacccatttgcc

SEQ ID NO: 125203 - DNA, 30 bp, Homo sapiens; identical to SEQ ID NO: 93300
  chr5:169127084-169127114
  Hypo

SEQ ID NO: 125204 - DNA, 102 bp, Homo sapiens; identical to SEQ ID NO: 93301
  chr5:169157436-169157538
  Hypo

SEQ ID NO: 125205 - DNA, 30 bp, Homo sapiens; identical to SEQ ID NO: 93302
  chr5:169158556-169158586
  Hypo

SEQ ID NO: 125206 - DNA, 30 bp, Homo sapiens; identical to SEQ ID NO: 93303
  chr5:169165242-169165272
  Hypo

SEQ ID NO: 125207 - DNA, 194 bp, Homo sapiens; identical to SEQ ID NO: 93304
  chr5:169323759-169323953
  Hypo

SEQ ID NO: 125208 - DNA, 223 bp, Homo sapiens; identical to SEQ ID NO: 93309
  chr5:169532899-169533122
  Hypo

SEQ ID NO: 125209 - DNA, 175 bp, Homo sapiens; identical to SEQ ID NO: 93310
  chr5:169655548-169655723
  Hypo

SEQ ID NO: 125210 - DNA, 143 bp, Homo sapiens; identical to SEQ ID NO: 40633
  chr5:169658356-169658499
  Hypo

SEQ ID NO: 125211 - DNA, 51 bp, Homo sapiens; identical to SEQ ID NO: 40634
  chr5:169660169-169660220
  Hypo

SEQ ID NO: 125212 - DNA, 96 bp, Homo sapiens; identical to SEQ ID NO: 93313
  chr5:169660603-169660699
  Hypo

SEQ ID NO: 125213 - DNA, 40 bp, Homo sapiens; identical to SEQ ID NO: 93314
  chr5:169866477-169866517
  Hypo

SEQ ID NO: 125214 - DNA, 154 bp, Homo sapiens; identical to SEQ ID NO: 93315
  chr5:169877679-169877833
  Hypo

SEQ ID NO: 125215 - DNA, 82 bp, Homo sapiens; identical to SEQ ID NO: 93316
  chr5:169930863-169930945
  Hyper

SEQ ID NO: 125216 - DNA, 293 bp, Homo sapiens
  chr5:169931191-169931484
  Hyper
cggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctc

SEQ ID NO: 125217 - DNA, 30 bp, Homo sapiens; identical to SEQ ID NO: 40635
  chr5:169932029-169932059
  Hypo

SEQ ID NO: 125218 - DNA, 30 bp, Homo sapiens; identical to SEQ ID NO: 93320
  chr5:170028243-170028273
  Hypo

SEQ ID NO: 125219 - DNA, 483 bp, Homo sapiens; identical to SEQ ID NO: 30084
  chr5:170107959-170108442
  Hyper

SEQ ID NO: 125220 - DNA, 41 bp, Homo sapiens; identical to SEQ ID NO: 93322
  chr5:170171099-170171140
  Hyper

SEQ ID NO: 125221 - DNA, 30 bp, Homo sapiens; identical to SEQ ID NO: 93323
  chr5:170171383-170171413
  Hyper

SEQ ID NO: 125222 - DNA, 90 bp, Homo sapiens
  chr5:170289230-170289320
  Hyper
tgcacaccccaggcccgggccggagcccgagaaaggggcggccgagcctgggttggaggcggcgggtggagggggcgggggacaggccca

SEQ ID NO: 125223 - DNA, 32 bp, Homo sapiens; identical to SEQ ID NO: 93324
  chr5:170289702-170289734
  Hyper

SEQ ID NO: 125224 - DNA, 30 bp, Homo sapiens; identical to SEQ ID NO: 93326
  chr5:170675080-170675110
  Hypo

SEQ ID NO: 125225 - DNA, 35 bp, Homo sapiens; identical to SEQ ID NO: 93327
  chr5:170687481-170687516
  Hypo

SEQ ID NO: 125226 - DNA, 21 bp, Homo sapiens
  chr5:170717082-170717103
  Hypo
atgactcgggccagacgcagt

SEQ ID NO: 125227 - DNA, 60 bp, Homo sapiens; identical to SEQ ID NO: 93329
  chr5:170733836-170733896
  Hyper

SEQ ID NO: 125228 - DNA, 2199 bp, Homo sapiens
  chr5:170737778-170739977
  Hyper
gcactctccttctcctccttcttccagcccgccctctcggattttcaacaatcctcgtggacgccggtttcctctccccccatctccgcgtctccattccagccgcgtttttatccgatctctgttttgattcaacccgtaaacggcgaagcgatcgcgtctggaaaggggttcaagacaggccctgggcgaactggatgagactgacccagcccccgggcgtcgtgcgggtggtgcagagccagcctgctcacccgcggaccccagcgaccccggttcccgcagggccaagtcagttacacataggccctgcccttgctatctggcgaaaggaacaatctttattgttggtgaagccacaatacccgggcgtgcaggtgggcggcgggcagagtcccctcctggagaccctctggcacacaacaaaaacaaatgatcctaaccggctccctggatataagagcctcgggcgtaaagcgcgggctgggaggcagacgggttctgcgcctcgaggctcccggatggcctcggctcccgggagggccggggccccgccggcggccccgcggtgccgggtgcatgacggtactgtccctctccctcccccggtgcaggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggcgggctgcgggggaaccggcgccgagaggggaaggggccgcctagcccgagtaggccccagggcgcggccacagactggcgggccgcggaagggggtagggcccgagctccgcgcggccgcacaatccgagcccccgccccgcgccccgtcccgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccggaactcagaactctaagcgctggtgtggtagcgtcgtggccggggtccacccagctccaccgtggctcaagagctggaagtttcagaattgcgaggtttggagcggctgaccccttccagtcacatctaacacacaaagcccgtgaacacttcctc

SEQ ID NO: 125229 - DNA, 2619 bp, Homo sapiens
  chr5:170735099-170737718
  Hyper
agagtttgcacctaacgattttagaattcgctggaagaaaatgattccgcttgtctccccaaagctgcagcggaaggtgactacttcgtgtgcggtcctgtccacggtgccctgggccgggtagacagtcactgaggcgcgagcagaacggggagtggttccagcgcccaaagtggactggagccgggaagggctcaccagtcgcgtttcccaaagaaatcccgcaatttgctctaggagctgcccgcgcctttgacattcaggaacccgaagtccctagacccgccgagccgcgagcgggttcccacgcgcgaccacagcccccttccatcctgcaacgaattacgagagtcaggtccccgctccccaccgggcgaccccgcgtccctagcccagccgcagctggcacgcgtgggcacctgcgagtcacgcctcggtccgcctggccggagccagggagtgtctccaaagtggccgcgaggccgcggccgaaacccgggcgggggcgaattctccccacgcgggtcggcgtcatccggggcgcggagaacgctacggtgctcccctcgccccgcgcgcaggcagcgcgaagcctgccccgggtagtgcgcccctttcgttcctccggcggcggtagcgtccaaggggcttctgcggattccgccgggtcgtcccggggttgcaactccattgtacctgaaaggatgcatttggtttggcttttgctcagatgaaaaaaaaaaaaaattggaagaaaacgaaaacccactcagcaaaagacaatttcacaagcggagcgctctacccacccagcgcggtgtctgggaagcggcccggcccggaggagcggggagcgtctgctaattgcagcttcgttagatttcgggtttgggaggctgtggttcgggctctaatatccgccgcccattatccctgctaataaatttgacctattgttcgtttgttaaaatgatgtcaccttggaacagtccctaagctcctatttccatgaattaggcctttattgaaagccgggagccaatgagaggagagaggcttgttgatcgcagccaatggctgcggcaggagaggaattagcagcggaaactccaggttcggttcaagaaagatgacacagagcctgtcgggcccgcgcactcttggcaaagtttcagtgcgacgagaggcgccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacaggtgagcagagctggcgaccaggctccaggcctccgccctctcggggccagaggcgccgcgccctgtgcgctccactcccggaaaccatttcagaggcccaagcgcggcggaggcctcggccccagggccccgggcagccgtggtggggagggtaatcggagagttgcaggaaaataagcccgtgcccgggggaagggacagggggcgagggggtctcccgaccggcttggtgtctctggaaacgcgcgcgaccagcgaaatagcggagctctccgtgtcccacggggcgccacggggtccgcatggggcctgaacggtggcggagccgggctgggcttcaggggccctcctgtgtctccgcagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccaccc

SEQ ID NO: 125230 - DNA, 139 bp, Homo sapiens; identical to SEQ ID NO: 93337
  chr5:170740191-170740330
  Hyper

SEQ ID NO: 125231 - DNA, 660 bp, Homo sapiens
  chr5:170740390-170741050
  Hyper
tctcttctttcctttctccctgactccctctctccctcttccaggcccagctcccagtagctcctaaggcaaaacactttcggggccgcgtcccagagcacccctcccactccacgagcacccccacccgcctcatcccactgcctccctcggagccggagccgtgcgccaccctgcaggttcccgtgctccgagccttcgttctatgcgggctgcgggactgtattcacctgcagggctggaggaaggggagggcgcctgagaaacaccttgaacccccagcgctcccgccgtcacctccacctccaagcccagctagcctgggatctgcgcctttcaggacataaagacacccagggagggactagggtgactcagaacttcgggtctcttccgtgagtgttttcctgaaatgcttttattttctccaataaaaagcctgatgaacgccgtcatcgggttgggaaaggttggcccttcggctgaggactagagggacccttgactttgctggcggagaagcgctttcctcagagacgggtgtcgcggtccagctcccttccgttccgttttattctgttgctccataataaggcctagcggggttttttttcttaattgtttttatttcaacgcgcttttggggaacagatggtcagg

SEQ ID NO: 125232 - DNA, 1380 bp, Homo sapiens
  chr5:170741470-170742850
  Hyper
ggattacaggcgtgagcccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcccggccgaggactggatggaggacgagaagcagcctgcctctgggcgacagctgcggacgcagcctcgccgcctcgccgcctcagcctcggtcccagcgtctctaaagccgcgcccattttacagatgcagggcagggagacaagaggcatctccgggggccgagtagaatgatggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggccgcgcagcgggtagggtatgggactgggggacgcaacggggacctggccgaatcagagccctcagcagagaacgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggct

SEQ ID NO: 125233 - DNA, 978 bp, Homo sapiens
  chr5:170743150-170744128
  Hyper
caaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccaccgggcccctgggcagggtaaccttagcctgtccgcttcggcagctttgcgaagagtggcgcgcagctagggctgaggctcttgcggacctgcggtcgaagcaggcggctgagccagttcgatcgccaaggcctgggctgccgacagtggtgcgcgctctgttccgccgcggccgggccaggcgctctggaatagcgatggggggacacggcctccaactttctgcagagaccatcgggcagctccgggcctaagcagcgacctcaccgaaggttcctgggaacctttgccaaaatcccagcctctgcctcggtccagctaaaccgtgtgtaaacaagtgcaccaaggccgcagagcggctggtgtggtgcaggcgcctgcgttctggagtagtgaaggttcctccacagggaaggcggttttccttccgtgaaattcgaaattcagccccccagttccaagcgcctgctccgttaatagcatctactctcagcgacgcccagacccaggctgtgcactgtcttggctcagacactggcaaagtcctcgagaaattgccttggtgatcggtgccttccctcgggccacccagccgccggtggcacggagtcttccgcgcagttgtgcggaccctcgctgtgtggccctg

SEQ ID NO: 125234 - DNA, 187 bp, Homo sapiens; identical to SEQ ID NO: 93346
  chr5:170744375-170744562
  Hyper

SEQ ID NO: 125235 - DNA, 381 bp, Homo sapiens; identical to SEQ ID NO: 93347
  chr5:170745099-170745480
  Hyper

SEQ ID NO: 125236 - DNA, 30 bp, Homo sapiens; identical to SEQ ID NO: 93348
  chr5:170749758-170749788
  Hypo

SEQ ID NO: 125237 - DNA, 30 bp, Homo sapiens; identical to SEQ ID NO: 93349
  chr5:170763990-170764020
  Hyper

SEQ ID NO: 125238 - DNA, 30 bp, Homo sapiens; identical to SEQ ID NO: 93350
  chr5:170786850-170786880
  Hypo

SEQ ID NO: 125239 - DNA, 41 bp, Homo sapiens; identical to SEQ ID NO: 40636
  chr5:170811632-170811673
  Hypo

SEQ ID NO: 125240 - DNA, 23 bp, Homo sapiens
  chr5:170813569-170813592
  Hypo
caacacagcgagactctgtctcc

SEQ ID NO: 125241 - DNA, 109 bp, Homo sapiens; identical to SEQ ID NO: 93353
  chr5:170847266-170847375
  Hyper

SEQ ID NO: 125242 - DNA, 30 bp, Homo sapiens
  chr5:170847714-170847744
  Hyper
gccggcgggctcagccgcaacaatataccc

SEQ ID NO: 125243 - DNA, 41 bp, Homo sapiens
  chr5:170848044-170848085
  Hyper
aggtggtgcagccctcgttggttccccgcctgctcccggtt

SEQ ID NO: 125244 - DNA, 71 bp, Homo sapiens; identical to SEQ ID NO: 40637
  chr5:170919575-170919646
  Hypo

SEQ ID NO: 125245 - DNA, 143 bp, Homo sapiens; identical to SEQ ID NO: 93357
  chr5:171021838-171021981
  Hypo

SEQ ID NO: 125246 - DNA, 30 bp, Homo sapiens; identical to SEQ ID NO: 93358
  chr5:171239105-171239135
  Hypo

SEQ ID NO: 125247 - DNA, 66 bp, Homo sapiens; identical to SEQ ID NO: 40638
  chr5:171247586-171247652
  Hypo

SEQ ID NO: 125248 - DNA, 30 bp, Homo sapiens; identical to SEQ ID NO: 93360
  chr5:171263972-171264002
  Hypo

SEQ ID NO: 125249 - DNA, 83 bp, Homo sapiens; identical to SEQ ID NO: 93361
  chr5:171382147-171382230
  Hypo

SEQ ID NO: 125250 - DNA, 39 bp, Homo sapiens; identical to SEQ ID NO: 40639
  chr5:171533619-171533658
  Hypo

SEQ ID NO: 125251 - DNA, 76 bp, Homo sapiens; identical to SEQ ID NO: 93363
  chr5:171708301-171708377
  Hypo

SEQ ID NO: 125252 - DNA, 30 bp, Homo sapiens; identical to SEQ ID NO: 93365
  chr5:172074582-172074612
  Hypo

SEQ ID NO: 125253 - DNA, 30 bp, Homo sapiens; identical to SEQ ID NO: 93369
  chr5:172189170-172189200
  Hypo

SEQ ID NO: 125254 - DNA, 30 bp, Homo sapiens; identical to SEQ ID NO: 93371
  chr5:172204547-172204577
  Hyper

SEQ ID NO: 125255 - DNA, 120 bp, Homo sapiens; identical to SEQ ID NO: 93372
  chr5:172235653-172235773
  Hypo

SEQ ID NO: 125256 - DNA, 36 bp, Homo sapiens; identical to SEQ ID NO: 93373
  chr5:172384947-172384983
  Hypo

SEQ ID NO: 125257 - DNA, 96 bp, Homo sapiens; identical to SEQ ID NO: 93374
  chr5:172385283-172385379
  Hypo

SEQ ID NO: 125258 - DNA, 157 bp, Homo sapiens; identical to SEQ ID NO: 93375
  chr5:172386958-172387115
  Hyper

SEQ ID NO: 125259 - DNA, 736 bp, Homo sapiens; identical to SEQ ID NO: 30104
  chr5:172655825-172656561
  Hyper

SEQ ID NO: 125260 - DNA, 862 bp, Homo sapiens
  chr5:172659392-172660254
  Hyper
acaaactctcccgtgcgcaagaacaaacgcgcgtgggacagaaaaagttcctaggtctccgcaggagtgaatgcaaaatccaggggactcagggtcatgttgggagccccttctccccccgagagtcagggagctgttgaggtgggatcggtcagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtcccctaggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagcacgctggccagctggtcgcgttcgggggccgacaggtaccgctgctgcttgaagcgccgctccagctcatagacctgcgcctgcgagaagagcacgcgcggcttcctccgccgtcgcgcccggggccgctccgcgttgtccgcctctgtcttctccagctccaccgccttctgcagcgcgcacagctctgagggggaacagagaggcagagagacgcttggtaagagcg

SEQ ID NO: 125261 - DNA, 39 bp, Homo sapiens; identical to SEQ ID NO: 93379
  chr5:172660469-172660508
  Hyper

SEQ ID NO: 125262 - DNA, 578 bp, Homo sapiens
  chr5:172660568-172661146
  Hyper
gggtgaactgaattagggctagtttggtttgagaagttaaatgaacagaggccgaggcctcactgctagggacggtcttatctcaaaattaaggaatcaagaaacagaaggccagggagtgttggtttggtgatcggaggctccagcctggccgcagcagggtttgcgcagtgtccaagaagctgcgggtgggcaggcggcctcggaacctgccttgctggcttcctcgaattggtagcgatcagttctagccgccgtgcccgcccgaatttgttcccaggcctctgctcctcaacaaacctatgaattctctcccggctggcagcggcccttcgcccagcgcttcgcccagcgcctgcggcctcccgggaatcgcccgggctcctgccttgggctggggggtctcccagaaggcccctttctgcagcggggccggcctccctccccgatcctgggatggcctgcgggatgatcccgcactcatctcgtccactcccttgtgcccgcggtagcgcagcatttcctaacttttccacgagggaacctctccgccctggccgcgccggcaagttgtgctg

SEQ ID NO: 125263 - DNA, 856 bp, Homo sapiens; identical to SEQ ID NO: 30109
  chr5:172661471-172662327
  Hyper

SEQ ID NO: 125264 - DNA, 30 bp, Homo sapiens; identical to SEQ ID NO: 93383
  chr5:172663838-172663868
  Hyper

SEQ ID NO: 125265 - DNA, 387 bp, Homo sapiens; identical to SEQ ID NO: 30110
  chr5:172664210-172664597
  Hyper

SEQ ID NO: 125266 - DNA, 501 bp, Homo sapiens; identical to SEQ ID NO: 93385
  chr5:172665448-172665949
  Hyper

SEQ ID NO: 125267 - DNA, 1082 bp, Homo sapiens
  chr5:172670755-172671837
  Hyper
gtatgtttcccaacccgaatttgtcctggattagtggatatgatccgctttcaaactagtgttagggtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggacaacgactcagatacagtgaagaggaaaatggttgtcctggggctggttcgcgcctgcccggcgggtgtgaagcccggggaaccgcgactttggaagaaccttcggcttggcggttcaggtttgggaaaagagagctggcgaactgccgcctgtttttgtgcccgcgcgggggaccagccgggccgacggcagcgctgcgggtgggttgggtcgtcggccgccgctccccggagaggtgaagagtcgcacctaccaccgggcagcctccgcggctctggccgaaaccccggctggccgcagctccgggagcccccagccctgtgctgctgcggccggctcagtgctgaattgatgctggaaacggctggccagcgggcctagggtcgccgcctttccctcctcgcctcttccttccttccgggtcgtgccctccaacctgctgtgcgttaccgcagccaagtttccaccgcccggcggagcgcattgtgaacagcagctgacaaattgttgtgttgcacacacacaccaaaaaaacccattcagtctcgtataattcggcgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggattcagacacgaaacgagcgcgctagaaagggtcgtgttgacacatcc

SEQ ID NO: 125268 - DNA, 40 bp, Homo sapiens; identical to SEQ ID NO: 93390
  chr5:172672286-172672326
  Hyper

SEQ ID NO: 125269 - DNA, 448 bp, Homo sapiens
  chr5:172672668-172673116
  Hyper
ctccgcgtttcctgtcgggagaggagtatcagcgcgcgcaccaaatctgctctggtatgtcaccttatctctcgtccccgctgttgtccccaaacgccgcctgtcaaaggagacgccacccgcattaggacctagactggggcccttccgctcggggtcaggcgcagcgccctcggcttgggccccgccgcccctttaggggtccgggagggtggagagaaggggcgggagccaggatgagggtgcggggggcctagaacccgaggctggtaggagagcaaactctcaaacgcgctgaaaccggcccatctgggagaaatattagggcgcatgtctctcccggagggcttccttttttttttttttcctaaccacgaaaatagggaatctttgttacaggctagttgtgagcgaatcctcctttgtccgcgtccggaggaaaatcagg

SEQ ID NO: 125270 - DNA, 30 bp, Homo sapiens; identical to SEQ ID NO: 93393
  chr5:172695117-172695147
  Hypo

SEQ ID NO: 125271 - DNA, 205 bp, Homo sapiens; identical to SEQ ID NO: 93394
  chr5:172704334-172704539
  Hypo

SEQ ID NO: 125272 - DNA, 109 bp, Homo sapiens; identical to SEQ ID NO: 30117
  chr5:172710849-172710958
  Hyper

SEQ ID NO: 125273 - DNA, 30 bp, Homo sapiens; identical to SEQ ID NO: 93396
  chr5:172726483-172726513
  Hypo

SEQ ID NO: 125274 - DNA, 1577 bp, Homo sapiens
  chr5:172754086-172755663
  Hyper
cccagcatgtggaggcgacaggatccgtaagaccccacgcgccgccggggcaggaccgcacagggccgccattcactcacttggggcgtccctaatgggcactcgtgcattccagctcgtgcggtgagcgcacgcacgccgccgctgccgcgttcacacggccccccaaagtcgggggaggggtcgtggagcgaaggagctgtaggcagattttctttctctttccgagctgggaaaagggccagccccgtgccctgcacgcctggctctgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaagagtttgcgtggccctgggtgggcgcctggctcccggcgaaacgcctggggcgcgccgcgtgggtgcacggtgtcctctcccagtagctcccggctgcgggggcacatgcacttacctgtattctgcagggacaggcggcctttctgctgggagctcctgtcttggggaccctcgggtgggttggtggcgtcggtcccccgcgccgggtcaaaggtggccaacaccaaagccagggtcatgaactggcccagccgctcggcacacatggttcttggtattaacctcccgtcgggagacctggatcctttgtgctcccctcttcctcctcctcctcttcctccttcgccgcttcccctcctcctcccactcttcctttttgctcgccttttccctcctcctcgcggccgcggctcggatagaggttacccagcgccctcccgtagctctccggagagcatgtgaccaggccgttagcagcgccgcgagtgcccggcaatggcagggatggtgcctcaaatatccctggaagctctggtgtcacttgaatgaaggagtcgagcaggtgttgtcccggcggctggaccaatccgagaccccggcccttttgacaacacggccgggaggcggggcctgcgctcaactactacaggaggaagccgagcgccgctgggagcgccggacaaagttgccgacctggcggcggccacgcgtttgcgtgcgtgtgtatgagtgt

SEQ ID NO: 125275 - DNA, 845 bp, Homo sapiens; identical to SEQ ID NO: 30122
  chr5:172756377-172757222
  Hyper

SEQ ID NO: 125276 - DNA, 36 bp, Homo sapiens; identical to SEQ ID NO: 93405
  chr5:172997890-172997926
  Hypo

SEQ ID NO: 125277 - DNA, 30 bp, Homo sapiens; identical to SEQ ID NO: 93409
  chr5:173165886-173165916
  Hypo

SEQ ID NO: 125278 - DNA, 30 bp, Homo sapiens; identical to SEQ ID NO: 93411
  chr5:173397062-173397092
  Hypo

SEQ ID NO: 125279 - DNA, 515 bp, Homo sapiens; identical to SEQ ID NO: 93412
  chr5:173738828-173739343
  Hyper

SEQ ID NO: 125280 - DNA, 30 bp, Homo sapiens; identical to SEQ ID NO: 93413
  chr5:173846564-173846594
  Hyper

SEQ ID NO: 125281 - DNA, 39 bp, Homo sapiens; identical to SEQ ID NO: 93414
  chr5:173846846-173846885
  Hyper

SEQ ID NO: 125282 - DNA, 30 bp, Homo sapiens; identical to SEQ ID NO: 40644
  chr5:174110957-174110987
  Hypo

SEQ ID NO: 125283 - DNA, 338 bp, Homo sapiens; identical to SEQ ID NO: 93416
  chr5:174115251-174115589
  Hyper

SEQ ID NO: 125284 - DNA, 30 bp, Homo sapiens; identical to SEQ ID NO: 93417
  chr5:174115938-174115968
  Hyper

SEQ ID NO: 125285 - DNA, 147 bp, Homo sapiens; identical to SEQ ID NO: 93418
  chr5:174119987-174120134
  Hyper

SEQ ID NO: 125286 - DNA, 39 bp, Homo sapiens; identical to SEQ ID NO: 93419
  chr5:174120367-174120406
  Hyper

SEQ ID NO: 125287 - DNA, 794 bp, Homo sapiens; identical to SEQ ID NO: 93420
  chr5:174147420-174148214
  Hyper

SEQ ID NO: 125288 - DNA, 37 bp, Homo sapiens; identical to SEQ ID NO: 30127
  chr5:174150431-174150468
  Hyper

SEQ ID NO: 125289 - DNA, 72 bp, Homo sapiens; identical to SEQ ID NO: 30128
  chr5:174151125-174151197
  Hyper

SEQ ID NO: 125290 - DNA, 326 bp, Homo sapiens; identical to SEQ ID NO: 93423
  chr5:174151443-174151769
  Hyper

SEQ ID NO: 125291 - DNA, 928 bp, Homo sapiens
  chr5:174158665-174159593
  Hyper
tcagatgggaggctccggtgactcggaacagaggcagaaaggatgcgaggacttcttgctgcgtaaacagcgcggcgggcagattggcacctggcacctaccaggactggcgcttcgtcccgcgtttccattgtgcccgcacgcactttgaaagtgggcgccggaaactccgtttttcttatggggccggggtcgggcaacgtggttcagaggtttcacaagctccagcacagaagtgatccaaaccgaggggtcggctcgaagtcggaggctgattttgtcttgctcagtcgctccgccggagctgagccgctggaacgacccaaacctacctgaaagcgcgtctctgcagtcccgctggacttctccggctcgaactcctaatctcagcccggaatccagccatattcatttaaggattgcgttttccaaaggccaaagcctttcccggtttcgtcatcagccgccaggttgggtccctaattagcctgtccaccgagcttccttcccggcgccgcttggaccccgcagccccgggcgatctcagcccgggtggggaatccggagacgccggctccgggttaagactctgctcgtccccaggaggacggggtcgcgatccagagtgcgatccggagaaaagggctgcatcttgcgtggctggcgggttagactggaatccgtctggggaactgcgcaccatccccatcgctccagacgccgaaacaaaacctgaggctcggagaggggaaaaagagttgttcaggctcgaacatacgcatcccagcctcataggtggatggggttaccgagctgagaaccaagccggaggtccgcgaagccgggccgcccccttgctctgggcctcccttcaagcctgcagtctggggatgggttccgagtcaccgcggtccgggcctcggtcagg

SEQ ID NO: 125292 - DNA, 30 bp, Homo sapiens; identical to SEQ ID NO: 30131
  chr5:174162217-174162247
  Hyper

SEQ ID NO: 125293 - DNA, 362 bp, Homo sapiens; identical to SEQ ID NO: 93427
  chr5:174162494-174162856
  Hyper

SEQ ID NO: 125294 - DNA, 80 bp, Homo sapiens; identical to SEQ ID NO: 93428
  chr5:174178168-174178248
  Hyper

SEQ ID NO: 125295 - DNA, 283 bp, Homo sapiens; identical to SEQ ID NO: 93429
  chr5:174178631-174178914
  Hyper

SEQ ID NO: 125296 - DNA, 112 bp, Homo sapiens
  chr5:174220830-174220942
  Hyper
gggctccagtctgagcgcctcctccgcgacgcgccacatggctggcaccggcgcgcccccgcgcggccgcctgcgagaagctcactctccgcggaggcgaaatctggttttg

SEQ ID NO: 125297 - DNA, 1267 bp, Homo sapiens; identical to SEQ ID NO: 93432
  chr5:174870699-174871966
  Hyper

SEQ ID NO: 125298 - DNA, 44 bp, Homo sapiens; identical to SEQ ID NO: 93434
  chr5:174921456-174921500
  Hypo

SEQ ID NO: 125299 - DNA, 950 bp, Homo sapiens
  chr5:175084819-175085769
  Hyper
ggcaagtgtcagagtcggcgagatgaggagggagggtgtaggagaaaggaaaatagaaagtgggtgagaccgtgggagagggagactgggggagaaaatgtgggcgtgtgcgcgctgagagagagagagagagagagagacttggagagggaaggaagggaaggagcgttgagagcaaggaggagcgagttgggggcggagacgaggaagtgggtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccaccgctccctggctgtgcctgaccttgggcaggtgcctccgcctggcctgcgagcctcagtttccttgtctgtgaccgcgggggtcgtgccttccccaagggggcgttgagagctcgggatgcagccccggtgcacagcagtgctcgggacgcgggtcggctttatatcccctttgcccgcgaagggtggatttggaaagtgcacttgcgccgaaacagtccccgttttgtctccgggtctgggtggtggcattttctcgcggcgatgtgtctgtcggagcatggagcaactttctgctaaagggaagccagcggagagcgggggctgctggggaggaggcttctatgtctcaggaaaccagaacgacctgccttcatcccgctgggctgccgcccgctgccggatgaccgatgaccggagccacaacaggcagcgctcagcgggtgggagtcctt

SEQ ID NO: 125300 - DNA, 30 bp, Homo sapiens; identical to SEQ ID NO: 40645
  chr5:175115079-175115109
  Hypo

SEQ ID NO: 125301 - DNA, 1492 bp, Homo sapiens
  chr5:175223481-175224973
  Hyper
tgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggttcgtagaacgcgcgctcgctccctgtggctgagccgccctcctccgcgggagcggttggcggagagaccccggccacaggccccgcgctcgagagcttcctagaggcggcttcctccggcctctccccctccctggagctctcagccgccggcggctcttccggggcgaggcagagggcgcctcgggcttctcgctccagcaccatctcggggacagctcccgcgccgcaccgggtccctatcgggtcagcactgcagcggcggacagcggcggccgggcgggctcctccgcaccctccgccctggttccgcgcggctgctaaggaccgtccctcgcccccgcgggccgctcccaacgctagcaccgcggcggcggacagctctctccggcggcaccgcgaaccgcgaacaaagccgcgggtctggggcccccagcgcgcctaggggtggcgtgaggccgcatcgatcgggggatttcagcttctcccagagaggtgtcaccggcgagctaggcgggggcctagcacagccgcgcgtctccggcttgggtccgccgcccgccgaggcctggccgtgcaatggcggggcccagctaagagtgggcaagaggtagaggggaaacaggcacagaacggtcccggctccgctaggcgggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcaggggggagggggcgacccagacagcaggttgcgaactcggcttagacctgggaggttgcaattagcaagaaaaaaggttgagggcgtctgtgaagccgggaggttcccaaacagggaagccagttccgcggcaggaaagcatacgtggaagagaaaccttttctctgagagctgaggctgggagggccctcggatcacgtgacactctagat

SEQ ID NO: 125302 - DNA, 1912 bp, Homo sapiens
  chr5:175298500-175300412
  Hyper
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcctggagtcttcgggaacgaccccttctgtgctctcgttctcgtcggcctcaatctgcccccttccccagcaaagtttgaaaccgggccgggtcttggggttggagctatgtgtgttgggggaaggggcgctctccgtggcccaccgggagatccaggacagagctgctgggggtgtgggtctccgcgggggtccgggagaggggcgccggggttcctgtcctctcttctggccgggaaacgggaacccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgcgcagggatagaccaaggcttcccgcagaatcgctaaggagcgcctcctggcggcctggcccaaatcctcaactgccggcaacctgctggacctcagcactcccgcaggcatatggcaaaacatacacacacacacaccctgcacacacgcacgcactcacacgatgtctaagtccagagttgcacacacggggtcatactttcaacgcacacaccctcatgcactcgttgacacgttaaattcaacccggcacacacgtcctcaggatcta

SEQ ID NO: 125303 - DNA, 151 bp, Homo sapiens; identical to SEQ ID NO: 93448
  chr5:175488087-175488238
  Hyper

SEQ ID NO: 125304 - DNA, 308 bp, Homo sapiens; identical to SEQ ID NO: 30150
  chr5:175560514-175560822
  Hyper

SEQ ID NO: 125305 - DNA, 136 bp, Homo sapiens; identical to SEQ ID NO: 40646
  chr5:175605006-175605142
  Hypo

SEQ ID NO: 125306 - DNA, 30 bp, Homo sapiens; identical to SEQ ID NO: 14798
  chr5:175610717-175610747
  Hypo

SEQ ID NO: 125307 - DNA, 230 bp, Homo sapiens; identical to SEQ ID NO: 93452
  chr5:175621329-175621559
  Hyper

SEQ ID NO: 125308 - DNA, 175 bp, Homo sapiens; identical to SEQ ID NO: 93453
  chr5:175626544-175626719
  Hyper

SEQ ID NO: 125309 - DNA, 1058 bp, Homo sapiens
  chr5:175792160-175793218
  Hyper
caaagcactacgatgcggcgttgggcgggttacttaactcctgggcctcggttttcccttctgcgtggtatcattgtaaggggtaacggagaaaagccgtgagctaacccctggtggatgctagcaagcaccgccgtctcccgtcctccccaggcacagcctctccttcctccaccctgcacctggcagggggaccggaggtccccgcgcgccggccagcgccccaccacccacgccgccgggtcccgggcggcctgccgtgacagcggcagtgcattgtggggcttgtagtgcgggactgggtctgggtgggtgggcgcggccgcagcagtcgcagcggggccatcttcggcgggcgagtgggctcggcctgtgcaacccgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaacgggtgggtgtgcttgggtgcgtgcggcgccttggcgccacgccgtcgctccacgccatgaggctcgggtgttccagcgggggccggagtttggagggcgcggctcgggagcatcccggggcccagccgggtcggctcgcgcccctccggcgcctgcgcagtgcaccccgcccgggggtggggatgtcgggagaaaccccatcccctcccgcctgcggtcgggactccgagaccggtggaggaagcggggcgcgcgagcgtttaaggaattcgccaagggtttgga

SEQ ID NO: 125310 - DNA, 30 bp, Homo sapiens; identical to SEQ ID NO: 93456
  chr5:175832567-175832597
  Hypo

SEQ ID NO: 125311 - DNA, 30 bp, Homo sapiens; identical to SEQ ID NO: 93457
  chr5:175844227-175844257
  Hypo

SEQ ID NO: 125312 - DNA, 17 bp, Homo sapiens
  chr5:175876289-175876306
  Hypo
cccccaggccaggagcg

SEQ ID NO: 125313 - DNA, 17 bp, Homo sapiens
  chr5:175876606-175876623
  Hypo
ttcgggagatcaaatgg

SEQ ID NO: 125314 - DNA, 19 bp, Homo sapiens
  chr5:175879322-175879341
  Hypo
tgctcggattacaggcgtg

SEQ ID NO: 125315 - DNA, 30 bp, Homo sapiens; identical to SEQ ID NO: 14801
  chr5:175924856-175924886
  Hypo

SEQ ID NO: 125316 - DNA, 151 bp, Homo sapiens; identical to SEQ ID NO: 93462
  chr5:175971719-175971870
  Hypo

SEQ ID NO: 125317 - DNA, 185 bp, Homo sapiens; identical to SEQ ID NO: 93463
  chr5:175972891-175973076
  Hypo

SEQ ID NO: 125318 - DNA, 30 bp, Homo sapiens; identical to SEQ ID NO: 14803
  chr5:175975036-175975066
  Hypo

SEQ ID NO: 125319 - DNA, 34 bp, Homo sapiens; identical to SEQ ID NO: 93465
  chr5:175978986-175979020
  Hypo

SEQ ID NO: 125320 - DNA, 393 bp, Homo sapiens
  chr5:176023853-176024246
  Hyper
cacactctgcagcagcgcgcggaacaggccgggcggacgcttggcggcgccatctgggggcgcggtgcgcaccgagcccgaacggccggggccggcacgggcggcgggcggcggcgcgggcgccccttggcggccgtgctcctcgatctgtcgctccagatgcttctggatggccatgcccagcacctccacctccatggcggcgccgtatacctcccacgtcatgcccttctcgtcccagctcacgtctcgcacgggctcagccggctccgggggcgctacagcggccgccagcgctgagccgggccgcacccgcacttcggggaaggcgggcggcgcggcggcttgaggtgtcatgggcccagtggccacggagcgcgtctcggcggcgcc

SEQ ID NO: 125321 - DNA, 108 bp, Homo sapiens; identical to SEQ ID NO: 93468
  chr5:176038513-176038621
  Hyper

SEQ ID NO: 125322 - DNA, 324 bp, Homo sapiens; identical to SEQ ID NO: 93469
  chr5:176046278-176046602
  Hyper

SEQ ID NO: 125323 - DNA, 659 bp, Homo sapiens; identical to SEQ ID NO: 30159
  chr5:176056505-176057164
  Hyper

SEQ ID NO: 125324 - DNA, 454 bp, Homo sapiens; identical to SEQ ID NO: 93471
  chr5:176057373-176057827
  Hyper

SEQ ID NO: 125325 - DNA, 533 bp, Homo sapiens
  chr5:176107053-176107586
  Hyper
tgcaggctgcagtgccgctctgctccggccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaatttattactggaggccgcagaaccagcggcgtggagtgcgcctcccgggagccgccgctgtcggagaaaggcacccacccgcctgggccggctcccgggcgcggggcggtgtctcagggaggcgtctcagccgagctgcagggcgaggggagcgagccgggtcccgggggaaggcatccggtcagggcctcgcccacccggatggctcctgcgccacggggcctgagctccgcctttgggatccgcgaggattggagactggggacccggcagcagagggtccaggcagaaaagctccgtgtggcccccagg

SEQ ID NO: 125326 - DNA, 313 bp, Homo sapiens
  chr5:176170309-176170622
  Hyper
ccgggggtgcgggtgcgccgagccctcgggaggcctggctctggtgtgggctgcggggagaaggcgcgggaaggaaggaaggaggcgaagcggtgcgggagggaggcggccgttgccatggaaggagctgcaaggtactctgggaccagaattctctctgcagagggtcgggtggggggcggccggctggggaaggtgaggggaaatccagtgccattcctttgtccttggcgcttctcagcctccctgcagaccgcgagcggagcccccgcacccccggggctggcccctggcctcccgccccagcccggcc

SEQ ID NO: 125327 - DNA, 30 bp, Homo sapiens; identical to SEQ ID NO: 93475
  chr5:176170885-176170915
  Hyper

SEQ ID NO: 125328 - DNA, 160 bp, Homo sapiens; identical to SEQ ID NO: 93476
  chr5:176225826-176225986
  Hypo

SEQ ID NO: 125329 - DNA, 828 bp, Homo sapiens
  chr5:176236431-176237259
  Hyper
aggcgtttgagtttgcgaccctgccctcaccctgctcattcccctcccgacccagactaggaccctctctttttccgatcactccccccaggcacaccgcacgcggctgtcatttcctttctccttcaaggcagccctctgtttattttaacccgattagggaatgggggtggggcacaggagactccagcagcggtcactgctggaggctccaggagacgacgtgacttgaccaaggtcacagagctggaaggtgaagtcgcctggaccctacccccggtctccctagctgccaaagcccagctcgttcctttacacccacgtcgcgggcgccgtgcgctctcggggctcaaacaccgcgcgcccagtcgggtgtgctgcgcctgaaggttgttttccttcggcgaacggcgccgaggggttagggaaaccttgggtcatggtgtgaggcgcgcccctggaatccaccagcctgcgaggctgggactgcgggtgtccccgagtctggcctgccagctctggtggccagggcacctctgcgcgcgggccagggccccggggctctcccgcagtcccctaaccaagccgcgggctggcagcgtaccgcggcgcccggacgaccccggagcgcggccgcgaggaaagggcgggggagaggactgcagcggaacctgcccggggcacccctgccctgggcggctctccgcaggctggcgccgcgccggggtcgccgcagccccgggcccctcccgggccacctgtgcgcagactggcgggcccgcgagagcccggatccggagcaccgatccactccgggtttcagactcc

SEQ ID NO: 125330 - DNA, 144 bp, Homo sapiens; identical to SEQ ID NO: 93479
  chr5:176237750-176237894
  Hyper

SEQ ID NO: 125331 - DNA, 30 bp, Homo sapiens; identical to SEQ ID NO: 93480
  chr5:176244317-176244347
  Hyper

SEQ ID NO: 125332 - DNA, 83 bp, Homo sapiens; identical to SEQ ID NO: 93481
  chr5:176244689-176244772
  Hyper

SEQ ID NO: 125333 - DNA, 103 bp, Homo sapiens; identical to SEQ ID NO: 93482
  chr5:176249208-176249311
  Hypo

SEQ ID NO: 125334 - DNA, 105 bp, Homo sapiens; identical to SEQ ID NO: 93483
  chr5:176264795-176264900
  Hyper

SEQ ID NO: 125335 - DNA, 45 bp, Homo sapiens; identical to SEQ ID NO: 93484
  chr5:176289688-176289733
  Hypo

SEQ ID NO: 125336 - DNA, 74 bp, Homo sapiens; identical to SEQ ID NO: 93485
  chr5:176295173-176295247
  Hypo

SEQ ID NO: 125337 - DNA, 60 bp, Homo sapiens; identical to SEQ ID NO: 93486
  chr5:176296603-176296663
  Hypo

SEQ ID NO: 125338 - DNA, 264 bp, Homo sapiens; identical to SEQ ID NO: 93487
  chr5:176315296-176315560
  Hypo

SEQ ID NO: 125339 - DNA, 30 bp, Homo sapiens; identical to SEQ ID NO: 93488
  chr5:176473003-176473033
  Hypo

SEQ ID NO: 125340 - DNA, 57 bp, Homo sapiens; identical to SEQ ID NO: 93490
  chr5:176558851-176558908
  Hypo

SEQ ID NO: 125341 - DNA, 69 bp, Homo sapiens; identical to SEQ ID NO: 93491
  chr5:176560249-176560318
  Hyper

SEQ ID NO: 125342 - DNA, 138 bp, Homo sapiens; identical to SEQ ID NO: 93492
  chr5:176764100-176764238
  Hypo

SEQ ID NO: 125343 - DNA, 163 bp, Homo sapiens; identical to SEQ ID NO: 40661
  chr5:176795125-176795288
  Hypo

SEQ ID NO: 125344 - DNA, 78 bp, Homo sapiens; identical to SEQ ID NO: 93494
  chr5:176864849-176864927
  Hypo

SEQ ID NO: 125345 - DNA, 52 bp, Homo sapiens; identical to SEQ ID NO: 93495
  chr5:176884410-176884462
  Hypo

SEQ ID NO: 125346 - DNA, 70 bp, Homo sapiens; identical to SEQ ID NO: 93496
  chr5:176911102-176911172
  Hypo

SEQ ID NO: 125347 - DNA, 154 bp, Homo sapiens; identical to SEQ ID NO: 93497
  chr5:177003236-177003390
  Hypo

SEQ ID NO: 125348 - DNA, 94 bp, Homo sapiens; identical to SEQ ID NO: 93498
  chr5:177019952-177020046
  Hypo

SEQ ID NO: 125349 - DNA, 30 bp, Homo sapiens; identical to SEQ ID NO: 93499
  chr5:177024976-177025006
  Hypo

SEQ ID NO: 125350 - DNA, 462 bp, Homo sapiens; identical to SEQ ID NO: 93500
  chr5:177031103-177031565
  Hypo

SEQ ID NO: 125351 - DNA, 30 bp, Homo sapiens; identical to SEQ ID NO: 93501
  chr5:177374034-177374064
  Hypo

SEQ ID NO: 125352 - DNA, 30 bp, Homo sapiens; identical to SEQ ID NO: 93502
  chr5:177385531-177385561
  Hypo

SEQ ID NO: 125353 - DNA, 149 bp, Homo sapiens; identical to SEQ ID NO: 93503
  chr5:177387547-177387696
  Hypo

SEQ ID NO: 125354 - DNA, 30 bp, Homo sapiens; identical to SEQ ID NO: 93504
  chr5:177408490-177408520
  Hypo

SEQ ID NO: 125355 - DNA, 883 bp, Homo sapiens
  chr5:177411327-177412210
  Hyper
actcttgtggagacccggacgtcaggcgtggcgcgttggggaagcagctccacggggacccaggaggcgccggccgggttgagccgggttggttccgacccaagagagctcgtcccacgacggagcaggtccctttgcatcccgcggggccgccaggtgcaattttcgctgggccgacggcgcggagatgggccagagtccggccatccagaagtgcctggagcgcacagcaaggccctgccctcggctccgtgaaggtgagggggtaaagtcggcccggagtccccgggggtgcaggaggggccccgcgggttccagcagaccctcgacggaacgttccaggcaggcgagatctcgcacagaatctgcccttttaaaggctcggctttgtcctcgttaaacttgcgtctggcaacgcgaccgctgcggctcccgagcaagattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcgg

SEQ ID NO: 125356 - DNA, 222 bp, Homo sapiens; identical to SEQ ID NO: 93507
  chr5:177412450-177412672
  Hyper

SEQ ID NO: 125357 - DNA, 25 bp, Homo sapiens
  chr5:177513856-177513881
  Hypo
tatttttttttgagacggagtctgt

SEQ ID NO: 125358 - DNA, 30 bp, Homo sapiens; identical to SEQ ID NO: 93509
  chr5:177541524-177541554
  Hyper

SEQ ID NO: 125359 - DNA, 22 bp, Homo sapiens
  chr5:177571459-177571481
  Hypo
aaaaaaggccaggcacggtggc

SEQ ID NO: 125360 - DNA, 28 bp, Homo sapiens
  chr5:177580093-177580121
  Hypo
acaaaaacgttaacgttcagttccttaa

SEQ ID NO: 125361 - DNA, 116 bp, Homo sapiens; identical to SEQ ID NO: 93512
  chr5:177581743-177581859
  Hypo

SEQ ID NO: 125362 - DNA, 198 bp, Homo sapiens; identical to SEQ ID NO: 93513
  chr5:177589638-177589836
  Hypo

SEQ ID NO: 125363 - DNA, 36 bp, Homo sapiens; identical to SEQ ID NO: 93514
  chr5:177593271-177593307
  Hypo

SEQ ID NO: 125364 - DNA, 30 bp, Homo sapiens; identical to SEQ ID NO: 30171
  chr5:177666777-177666807
  Hyper

SEQ ID NO: 125365 - DNA, 30 bp, Homo sapiens; identical to SEQ ID NO: 40665
  chr5:177673744-177673774
  Hypo

SEQ ID NO: 125366 - DNA, 21 bp, Homo sapiens
  chr5:177680874-177680895
  Hypo
ccatctctggctgggcgtggt

SEQ ID NO: 125367 - DNA, 196 bp, Homo sapiens; identical to SEQ ID NO: 93518
  chr5:177713344-177713540
  Hypo

SEQ ID NO: 125368 - DNA, 30 bp, Homo sapiens; identical to SEQ ID NO: 93519
  chr5:177713980-177714010
  Hypo

SEQ ID NO: 125369 - DNA, 96 bp, Homo sapiens; identical to SEQ ID NO: 93520
  chr5:177723606-177723702
  Hypo

SEQ ID NO: 125370 - DNA, 30 bp, Homo sapiens; identical to SEQ ID NO: 93521
  chr5:177750053-177750083
  Hypo

SEQ ID NO: 125371 - DNA, 29 bp, Homo sapiens
  chr5:177753998-177754027
  Hypo
gtgagccactgcaccgggccaaaaatgac

SEQ ID NO: 125372 - DNA, 30 bp, Homo sapiens; identical to SEQ ID NO: 93523
  chr5:177767895-177767925
  Hypo

SEQ ID NO: 125373 - DNA, 34 bp, Homo sapiens; identical to SEQ ID NO: 93524
  chr5:177807711-177807745
  Hypo

SEQ ID NO: 125374 - DNA, 48 bp, Homo sapiens; identical to SEQ ID NO: 93525
  chr5:177827431-177827479
  Hypo

SEQ ID NO: 125375 - DNA, 22 bp, Homo sapiens
  chr5:177829100-177829122
  Hypo
gccaccgcgcccagctgccttt

SEQ ID NO: 125376 - DNA, 40 bp, Homo sapiens; identical to SEQ ID NO: 93527
  chr5:177850350-177850390
  Hypo

SEQ ID NO: 125377 - DNA, 181 bp, Homo sapiens; identical to SEQ ID NO: 40667
  chr5:177851456-177851637
  Hypo

SEQ ID NO: 125378 - DNA, 30 bp, Homo sapiens; identical to SEQ ID NO: 93529
  chr5:177868563-177868593
  Hypo

SEQ ID NO: 125379 - DNA, 30 bp, Homo sapiens; identical to SEQ ID NO: 93530
  chr5:177882733-177882763
  Hypo

SEQ ID NO: 125380 - DNA, 344 bp, Homo sapiens; identical to SEQ ID NO: 93531
  chr5:177890891-177891235
  Hypo

SEQ ID NO: 125381 - DNA, 30 bp, Homo sapiens; identical to SEQ ID NO: 14810
  chr5:177982679-177982709
  Hypo

SEQ ID NO: 125382 - DNA, 166 bp, Homo sapiens; identical to SEQ ID NO: 93534
  chr5:177984059-177984225
  Hypo

SEQ ID NO: 125383 - DNA, 239 bp, Homo sapiens
  chr5:178003647-178003886
  Hyper
ggtcgtggagggccccgggctgttcctgatcctcgaactctctcctccccacggccgcggtctcctccccgggccccgcgcgccaggccctgcgaaaagccccaacgggtcccccggcgaccgccgcgccggcctctcggtcctgtcctccgaggcgccaggcctccgcctccagcgcgggcctctcgggcagcgccgcccctccccctgcgcgcacgggaggccgcctgggttcggct

SEQ ID NO: 125384 - DNA, 279 bp, Homo sapiens
  chr5:178004095-178004374
  Hyper
tgtgggccgaggccccggcgctcctcgctcagcccaactcccaaggcccagcgggtccctgctctgccgtccggggatcccgcgggtggtccggagcccggggcgcggcgcgccgttcattcccgcgtcctggcggggcctgcttcttcccgagccctctccctgcggctggtggtcccagcgtgctggccgcgtctcccctcttctcgggacaccagccctgttggatcagggcccccccacaacgacctgtgccacctcatccgcctctttaaagac

SEQ ID NO: 125385 - DNA, 1348 bp, Homo sapiens
  chr5:178016588-178017936
  Hyper
tccgagcgcacaccccgtggagactgaccctaggtctgttactccaaagtccctggtctctccttcccctttctcgcggccgcctgcctggcacgggaccctgaggccggagcggagaccgcaaaaccccttggggccggcaccccctgcctccgccttggcgcagacgtgcccatctctgggacggccccgagcgcacgcagccggcgggcgaccctcctcccagagacctgcacgctgcccccggctcccagcgtaccgccaccctcaacccgacacacccaagtccgccccagccacgcgccaagacgctcacctcccgcagcaggcgctccaggtgcggctcggcccaggcgtccagggcgcctggcggccccgcgcgccgcagcagctcccgctcctcctcgagcgccgccacccggccctgcagcgcggccgcctggacacccagcagcaggcaggcagccgccgagcccacggagagcagcaggcacagcgcgctcaccgcccgggacccggccgtcgtcgccgagcgccctccgccgccgccgcccgccgcattgcccttccccgcgtcgccgccgccaccggcgcgctcgcctgggcccatggcgcgttcgtcgcgcgtggactctccgagggggcggtgctgctggggcagaggctgggtgcgagaggagcaggcgggacagcccgaggcacgaggtccgccgggcgcgggggttagcctccgggtagcagcggatcgccgcgcacgcccccttcgccgcagccagctcctccacagcggccactttgggcagtttcctctatgcaaatagaccctgccagaaaaggagcagggacccacccaggggaggagcggccgggctggccccgcgcggcgagggggcgggggcgaggaaggagcgagctcctcggagccacccgtcggcgccgggctgatcccacgcgcagcgcgcacctctgccctcacctagcccgggcgccggcacccgcccccgcacgcacctctgaggcttccccagcccaagcccgcactgtggaccccagaggtcggaggggagcccggcgacaccgcgccccttctgcagcccacccctggctggagcacccaccactcgtgccttagcacattcctctaaacttgtgaattacctttctgacacttgtaaaagttcaaaacttcaaatcctgcaaaaaactgagtgggtctgtcctcggtggtggattagcgccgcttcgtggcggaaagcgacctctgcgcactcacatttagagaggcagggtcgagattgcgccaaacagaaatacgccccttagaatcttctcacgagttcttagctgc

SEQ ID NO: 125386 - DNA, 96 bp, Homo sapiens; identical to SEQ ID NO: 93541
  chr5:178108636-178108732
  Hypo

SEQ ID NO: 125387 - DNA, 153 bp, Homo sapiens; identical to SEQ ID NO: 40671
  chr5:178112320-178112473
  Hypo

SEQ ID NO: 125388 - DNA, 22 bp, Homo sapiens
  chr5:178117247-178117269
  Hypo
tatttatcgcctcacatagtta

SEQ ID NO: 125389 - DNA, 176 bp, Homo sapiens; identical to SEQ ID NO: 93544
  chr5:178194091-178194267
  Hypo

SEQ ID NO: 125390 - DNA, 30 bp, Homo sapiens; identical to SEQ ID NO: 93545
  chr5:178195637-178195667
  Hypo

SEQ ID NO: 125391 - DNA, 90 bp, Homo sapiens; identical to SEQ ID NO: 93546
  chr5:178216871-178216961
  Hypo

SEQ ID NO: 125392 - DNA, 165 bp, Homo sapiens; identical to SEQ ID NO: 40672
  chr5:178288343-178288508
  Hypo

SEQ ID NO: 125393 - DNA, 81 bp, Homo sapiens
  chr5:178323168-178323249
  Hyper
ttccccaggagctggcggcgggagcacgctggcagctgagtgtccttcggcgctgtcctgggcaggcgccgaggtggaatc

SEQ ID NO: 125394 - DNA, 502 bp, Homo sapiens
  chr5:178367881-178368383
  Hyper
ccatcttcagcttttcgctgatctgcatcttcctgcgccttagtgcaaggcagagacctggttctaaagcgaacggaacggaaccgattctgtaagttgcaatgagcgcgctgaggtcggcgtggaggggtctctgggaaaggtagtttccgcgcctaaagcgccggggccgggccctgttcccgcaggcgcaaggcagcactgtctccgccgattgtccctctgggaagtggagtctggccggcggaactgcagcagccctgagacttgtgggaattcggcccaagggttcccagggcaacgcgcaagcgcagttcggctcccggctgcagactccagctcattgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccga

SEQ ID NO: 125395 - DNA, 30 bp, Homo sapiens; identical to SEQ ID NO: 40673
  chr5:178373124-178373154
  Hypo

SEQ ID NO: 125396 - DNA, 30 bp, Homo sapiens; identical to SEQ ID NO: 93551
  chr5:178400566-178400596
  Hypo

SEQ ID NO: 125397 - DNA, 94 bp, Homo sapiens; identical to SEQ ID NO: 93552
  chr5:178409975-178410069
  Hypo

SEQ ID NO: 125398 - DNA, 141 bp, Homo sapiens; identical to SEQ ID NO: 93553
  chr5:178411620-178411761
  Hypo

SEQ ID NO: 125399 - DNA, 34 bp, Homo sapiens; identical to SEQ ID NO: 93554
  chr5:178414393-178414427
  Hypo

SEQ ID NO: 125400 - DNA, 164 bp, Homo sapiens; identical to SEQ ID NO: 93555
  chr5:178416046-178416210
  Hypo

SEQ ID NO: 125401 - DNA, 549 bp, Homo sapiens
  chr5:178421464-178422013
  Hyper
cgaccatgatggagacggagctggccgaggcgcccacgacggccacgacgcgctcggggggcgcggggcgcagcggagggacgcctcccgggcagcgcacgcccacctcgtcgccgtcgccgcggccgcggatcagcgcctgcacgaagctcagcgcctgctccagcgcgtaggtgtcccgcgagcaggtgtccagcagccgcgcgcccaggcgcacgccgggcagcagctcggggtcggcgttgacgcggtccagcgcgtacagcatggcctccagccggtgcacgccctgctccttcttcagctgcccgcacgcccggcccgccgcgccccgcgcgtgcaccgggaacaggccgcccagcgtcaggccgcccgccaggcgcacagagcccgccgcgcgcgccaggcccgcctgcgccagccacgccagcggcagcagcgccacgagcagcggctcccgggctctccggggccgcgccatcggctcgtctagcgggctgcggggagacagaggggcggggagcgctctgagggcgggggaaggagagc

SEQ ID NO: 125402 - DNA, 43 bp, Homo sapiens; identical to SEQ ID NO: 30176
  chr5:178422264-178422307
  Hyper

SEQ ID NO: 125403 - DNA, 574 bp, Homo sapiens; identical to SEQ ID NO: 93557
  chr5:178450579-178451153
  Hyper

SEQ ID NO: 125404 - DNA, 102 bp, Homo sapiens; identical to SEQ ID NO: 93558
  chr5:178478883-178478985
  Hypo

SEQ ID NO: 125405 - DNA, 90 bp, Homo sapiens; identical to SEQ ID NO: 40678
  chr5:178481810-178481900
  Hypo

SEQ ID NO: 125406 - DNA, 669 bp, Homo sapiens
  chr5:178487107-178487776
  Hyper
aatgaatctaatttccggttttgttttttcaaactactccgcttgcttaacaagtgcgcgggctgtaggcagcacggccagcagctggagacctcctgcctcgtgtgcggcgtgcgtactccctcgcactgcagcccctccgcgcactgtcgcctttgagagctctcgttggcggaggcggttcctctcccggagttcgcagcgcgcaccgcggcgtcccctgggaagtgtagtcggcgtggggccggaggcatgccgggagtggtagttctcccgcggttggcggggtttcggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtgcattttcttctgagtaacggaaataataaaag

SEQ ID NO: 125407 - DNA, 117 bp, Homo sapiens; identical to SEQ ID NO: 93562
  chr5:178488196-178488313
  Hypo

SEQ ID NO: 125408 - DNA, 77 bp, Homo sapiens; identical to SEQ ID NO: 93563
  chr5:178551846-178551923
  Hypo

SEQ ID NO: 125409 - DNA, 30 bp, Homo sapiens; identical to SEQ ID NO: 93564
  chr5:178556809-178556839
  Hypo

SEQ ID NO: 125410 - DNA, 164 bp, Homo sapiens; identical to SEQ ID NO: 93565
  chr5:178561609-178561773
  Hypo

SEQ ID NO: 125411 - DNA, 41 bp, Homo sapiens; identical to SEQ ID NO: 40680
  chr5:178565442-178565483
  Hypo

SEQ ID NO: 125412 - DNA, 152 bp, Homo sapiens; identical to SEQ ID NO: 93567
  chr5:178566307-178566459
  Hypo

SEQ ID NO: 125413 - DNA, 145 bp, Homo sapiens; identical to SEQ ID NO: 40681
  chr5:178576381-178576526
  Hypo

SEQ ID NO: 125414 - DNA, 30 bp, Homo sapiens; identical to SEQ ID NO: 93569
  chr5:178580513-178580543
  Hypo

SEQ ID NO: 125415 - DNA, 403 bp, Homo sapiens
  chr5:178594068-178594471
  Hyper
ccagcaggaagtcaccgtccgcaaggagcgccccgctaggctcaggcttggcacacgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgacatttccattgt

SEQ ID NO: 125416 - DNA, 186 bp, Homo sapiens; identical to SEQ ID NO: 93571
  chr5:178612233-178612419
  Hypo

SEQ ID NO: 125417 - DNA, 45 bp, Homo sapiens; identical to SEQ ID NO: 93572
  chr5:178634584-178634629
  Hypo

SEQ ID NO: 125418 - DNA, 30 bp, Homo sapiens; identical to SEQ ID NO: 93573
  chr5:178635361-178635391
  Hypo

SEQ ID NO: 125419 - DNA, 210 bp, Homo sapiens; identical to SEQ ID NO: 40682
  chr5:178655698-178655908
  Hypo

SEQ ID NO: 125420 - DNA, 99 bp, Homo sapiens; identical to SEQ ID NO: 93575
  chr5:178665413-178665512
  Hypo

SEQ ID NO: 125421 - DNA, 128 bp, Homo sapiens; identical to SEQ ID NO: 93576
  chr5:178684538-178684666
  Hypo

SEQ ID NO: 125422 - DNA, 43 bp, Homo sapiens; identical to SEQ ID NO: 93577
  chr5:178699920-178699963
  Hypo

SEQ ID NO: 125423 - DNA, 64 bp, Homo sapiens; identical to SEQ ID NO: 93578
  chr5:178737203-178737267
  Hypo

SEQ ID NO: 125424 - DNA, 48 bp, Homo sapiens; identical to SEQ ID NO: 93579
  chr5:178739679-178739727
  Hypo

SEQ ID NO: 125425 - DNA, 74 bp, Homo sapiens; identical to SEQ ID NO: 93580
  chr5:178740136-178740210
  Hypo

SEQ ID NO: 125426 - DNA, 2093 bp, Homo sapiens
  chr5:178770743-178772836
  Hyper
ggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccgggcgccacgaggcgggcgttgggccgcagccgcaggtgcaggtctcggccaaagaccgtgacattgtagaagaggtgactgccaggctcctcctcgttgcctccggggaagctcggggtccggaccggggcggccctgcgggctcgtacccctgctctggacgtagctgccgacaccacgtgggacaccaagcggccctgggcgtcagtgcgcacgggcaccgccaggatgcgctccgctccgtgccccaggggcccgcctgcaacgggaaggggcgttagatcggcggagaccacggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggagtctcggcttccccgagcacgagcggcctgtcctgcctgtccagctcccgctcagcccgctgccggccccgtctccccgagcgcccgaggactgggaggggtggaacagggtccctccgatctccggggattccctgcggggcgccccaaccaatccttagggcccaaggctacgcgctcggcagccggctcctccggagcgtccccggacgcgagccccggcgccgcctcgccctggctcccccctcggacccgctggggctgactctgcgctcttggccgcggggcttttcccggccctccgtccccaccctccgcgactcaggagccgccagtgctccgaggctcccccggcccaaggcgctcgggggcggtgcggggcgccccctgcgcgaccaacccggccccgaagttggccaacttggccccgggcggggcgcgcggagtttgcccaagtcaggctggacgacgcctggggagggggcggcggggcacgcgggacagggccaggccggcgggggtcccggggagtaggggccgggccgcacctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggccgggggagccccgccgccagccaccccaggggcacaacctccgaggagcggcgccggccgaacgtccccacctagagagcccttggggtgccgggtcccacccatc

SEQ ID NO: 125427 - DNA, 30 bp, Homo sapiens; identical to SEQ ID NO: 93587
  chr5:178788838-178788868
  Hypo

SEQ ID NO: 125428 - DNA, 30 bp, Homo sapiens; identical to SEQ ID NO: 93588
  chr5:178794198-178794228
  Hypo

SEQ ID NO: 125429 - DNA, 219 bp, Homo sapiens; identical to SEQ ID NO: 93589
  chr5:178836785-178837004
  Hypo

SEQ ID NO: 125430 - DNA, 49 bp, Homo sapiens; identical to SEQ ID NO: 40685
  chr5:178854790-178854839
  Hypo

SEQ ID NO: 125431 - DNA, 17 bp, Homo sapiens
  chr5:178861589-178861606
  Hypo
tttttttttttgagacg

SEQ ID NO: 125432 - DNA, 96 bp, Homo sapiens; identical to SEQ ID NO: 93592
  chr5:178877445-178877541
  Hypo

SEQ ID NO: 125433 - DNA, 90 bp, Homo sapiens; identical to SEQ ID NO: 93593
  chr5:178878660-178878750
  Hypo

SEQ ID NO: 125434 - DNA, 30 bp, Homo sapiens; identical to SEQ ID NO: 40687
  chr5:178882544-178882574
  Hypo

SEQ ID NO: 125435 - DNA, 86 bp, Homo sapiens; identical to SEQ ID NO: 93595
  chr5:178882941-178883027
  Hypo

SEQ ID NO: 125436 - DNA, 30 bp, Homo sapiens; identical to SEQ ID NO: 93596
  chr5:178883436-178883466
  Hypo

SEQ ID NO: 125437 - DNA, 37 bp, Homo sapiens; identical to SEQ ID NO: 93597
  chr5:178907047-178907084
  Hypo

SEQ ID NO: 125438 - DNA, 75 bp, Homo sapiens; identical to SEQ ID NO: 93598
  chr5:178913784-178913859
  Hypo

SEQ ID NO: 125439 - DNA, 386 bp, Homo sapiens
  chr5:178957560-178957946
  Hyper
cgccgggtctgtggacgcggatccgaatcggagcttccgagggtgatctgagatccaaagtcaggagtcttctgcatcctgccctttgtcagcgctggtcctcatttcacctgcccagggccttcaggaggggcgacactctccggctgcgggcggcccagcgctcgcccccctcggccccacgtactcttcctgcctcgcccccatcgccctcctccggcttcccgcgcctcccggggctctgcgcttgcgtccagggcgccctctccggggacaatgggcgggtgcttcgcaggctgcagtcagggccgacttcacccggcgaggacagggcgaggcgctgggcccagaggtatgtttgaaacgattcgcgtatgtgaatctac

SEQ ID NO: 125440 - DNA, 19 bp, Homo sapiens
  chr5:178969579-178969598
  Hypo
agaatgggccaggtgcggt

SEQ ID NO: 125441 - DNA, 120 bp, Homo sapiens; identical to SEQ ID NO: 93601
  chr5:178978788-178978908
  Hypo

SEQ ID NO: 125442 - DNA, 35 bp, Homo sapiens; identical to SEQ ID NO: 40689
  chr5:178987430-178987465
  Hypo

SEQ ID NO: 125443 - DNA, 379 bp, Homo sapiens; identical to SEQ ID NO: 93603
  chr5:179213899-179214278
  Hypo

SEQ ID NO: 125444 - DNA, 495 bp, Homo sapiens
  chr5:179243847-179244342
  Hyper
ccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctc

SEQ ID NO: 125445 - DNA, 30 bp, Homo sapiens; identical to SEQ ID NO: 93606
  chr5:179263484-179263514
  Hypo

SEQ ID NO: 125446 - DNA, 30 bp, Homo sapiens; identical to SEQ ID NO: 93607
  chr5:179401303-179401333
  Hypo

SEQ ID NO: 125447 - DNA, 50 bp, Homo sapiens; identical to SEQ ID NO: 40691
  chr5:179401725-179401775
  Hypo

SEQ ID NO: 125448 - DNA, 30 bp, Homo sapiens; identical to SEQ ID NO: 93609
  chr5:179448856-179448886
  Hypo

SEQ ID NO: 125449 - DNA, 109 bp, Homo sapiens; identical to SEQ ID NO: 93612
  chr5:179498254-179498363
  Hyper

SEQ ID NO: 125450 - DNA, 30 bp, Homo sapiens; identical to SEQ ID NO: 30192
  chr5:179498867-179498897
  Hyper

SEQ ID NO: 125451 - DNA, 30 bp, Homo sapiens; identical to SEQ ID NO: 93614
  chr5:179499226-179499256
  Hyper

SEQ ID NO: 125452 - DNA, 34 bp, Homo sapiens; identical to SEQ ID NO: 93616
  chr5:179535480-179535514
  Hypo

SEQ ID NO: 125453 - DNA, 30 bp, Homo sapiens; identical to SEQ ID NO: 93617
  chr5:179546275-179546305
  Hypo

SEQ ID NO: 125454 - DNA, 35 bp, Homo sapiens; identical to SEQ ID NO: 93618
  chr5:179557921-179557956
  Hypo

SEQ ID NO: 125455 - DNA, 333 bp, Homo sapiens; identical to SEQ ID NO: 93619
  chr5:179564509-179564842
  Hypo

SEQ ID NO: 125456 - DNA, 30 bp, Homo sapiens; identical to SEQ ID NO: 93620
  chr5:179621876-179621906
  Hypo

SEQ ID NO: 125457 - DNA, 335 bp, Homo sapiens; identical to SEQ ID NO: 93621
  chr5:179635756-179636091
  Hyper

SEQ ID NO: 125458 - DNA, 155 bp, Homo sapiens
  chr5:179636151-179636306
  Hyper
cgaccgcccggctcccagcgcagcccgcacgagcgcctggcggcggccccggagcaacgcggcgctgcgccccctcgtggcactcaggcagcgcggagcgggcggggcgcgggggtggagctgcgggagcccgcgggcggcgctgcacaccaggg

SEQ ID NO: 125459 - DNA, 30 bp, Homo sapiens; identical to SEQ ID NO: 93624
  chr5:179653659-179653689
  Hypo

SEQ ID NO: 125460 - DNA, 157 bp, Homo sapiens; identical to SEQ ID NO: 93625
  chr5:179742465-179742622
  Hypo

SEQ ID NO: 125461 - DNA, 54 bp, Homo sapiens; identical to SEQ ID NO: 93626
  chr5:179779378-179779432
  Hyper

SEQ ID NO: 125462 - DNA, 1644 bp, Homo sapiens
  chr5:179779648-179781292
  Hyper
acgttcctttggggtcgcgaggaggacgcgcaggccctgcctgaggcactgacgcagcgggggcgaccgggcgggctgcggggacggcggggcggggtcgcctctcctctcctcggtgggcgcggcgggctgagtcgggatgggcgccccgcactcgggatgcgccggcctgcgcgtggccgcctttgtgggcgactgggagacgtggaggagagcgacctcggtcggcatggggtggggacccctctgttacggggtccaggccggaccggaccaggtccctcccctccgtggggaccgggcctcggtccccctcactgtgtccgagaccaggagtcgggttgggcatcccccacccacacctccgagacggccactcggggaacgcgggtgaggggcagccaggcccggccgacgacagcccctcggtaggggcccggggcagatcggcgcccccagccaggtcctcggcgcctgcttgcgggcggaggcgcggagaggctgcggcgccgggacccgcggacggcgtggaggaggcggctcgggcgggcgcggcactcaccgcacatcgtggctgcttctcgggctccttcgcggctcgagggggtctgcccgttcggacgctggggctcctccgtgggctcctccgtgggctccgtgggctccgtgggctccgcgggctccagctcccgtccgctcggcctccagcccttataacccggagccctccgagagggcggggaagggggcggggaaggggcggggcttcccccgcccgcctgctcccattggcccccggttgtcgtgacaacgacgggacccggcccccaggagccagggaggggggccgaggggcggctcccaggcgcgggtcgggcgtgtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacggggtgctgagaagtcagacgggccgcgtaaggggcagagcgaggggtccggcatcactcgcgcgctccggaaacccgcgtgagccgctgttcctgccgcgctcccatctgagtgacaggcttgtttcagagctccgcagacctctaagcctggccctcaccctgcgtggagagaacgcccgggcttggcggagagacgagaaaaccgaggctcccggaggcagacaaggactctgccaaaaccggacgccgcggcggtggcagaattcgaccctgggatttgccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcactctgggcccctcgtctcccgaggaaggtcacgagaaccggcccaacgtttgcgcactttgaagttt

SEQ ID NO: 125463 - DNA, 34 bp, Homo sapiens; identical to SEQ ID NO: 93630
  chr5:179824602-179824636
  Hypo

SEQ ID NO: 125464 - DNA, 135 bp, Homo sapiens; identical to SEQ ID NO: 93631
  chr5:179867486-179867621
  Hyper

SEQ ID NO: 125465 - DNA, 43 bp, Homo sapiens; identical to SEQ ID NO: 93632
  chr5:180011938-180011981
  Hypo

SEQ ID NO: 125466 - DNA, 1561 bp, Homo sapiens
  chr5:180017118-180018679
  Hyper
tttattgagaggggccgggggaaggggatggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggccttcagggccttcacggcccccacggcctggggacccagctcagccacacacttctgggagccctctatgaggtggttcacggggatgcccaggctgctcagcaggagcttcagcgggttgagggtgccgagggggttggccagggtcccggccccggcctccgccgccgactccagcgcagcgacaggctgggccacaggcttggccgagcccactaagaaagcagcagctgcaagcgaacagggaggggtcaccgcctgcgcgccggggtccccagaaggcaggtccaggacgcgcccccgcgggaggcgcccaggaaccgtcgcgccctgcccggctccccgaccgcccctccctcctgcgccgaggcctgccaggtgcgagcccccgggacacaggcgggtctggggaggcggccccgccaggagacgctgcagggtcaccggagtggcctgagggtggcggaaggaccggtgaactctgtgcagggtccgggacaggcccccaagggaggggacactcgcgctgcgccttgcaggatgaggagccggtctccagacggggggcagacgggtgtccccaggccaggggcggcctccatcccggcacgaggctggagacagccctgagagggggaggccgcgggctgcaggcgcggggccccggggtggcggagccctctgggcgccgggcgaggctggaaggacctgggatccacgatcggcgcaggcagcggcgggggcgcagcgggcgccgaggcctcaggccccaccgtgcgcgccaggagcccggggcgctcaccggagctgcaggacagggccacgcagagccccaggagggcggcgagcttcatggcgcgggggctcggggcgcgcggggaacctgcggctgcccgggcaaggccacgaggcttcttatacccggtcctcgcccctccagcgccggcctcgcccgcgctcctgagaaagccctgcccgctccgctcacggccgtgccctggccaacttcctgctgcggccggcgggccctgggaagcccgtgcccccttccctgcccgggcctcgaggact

SEQ ID NO: 125467 - DNA, 30 bp, Homo sapiens; identical to SEQ ID NO: 93636
  chr5:180019434-180019464
  Hypo

SEQ ID NO: 125468 - DNA, 30 bp, Homo sapiens; identical to SEQ ID NO: 40693
  chr5:180021394-180021424
  Hypo

SEQ ID NO: 125469 - DNA, 82 bp, Homo sapiens; identical to SEQ ID NO: 93638
  chr5:180028458-180028540
  Hypo

SEQ ID NO: 125470 - DNA, 289 bp, Homo sapiens; identical to SEQ ID NO: 93639
  chr5:180033320-180033609
  Hypo

SEQ ID NO: 125471 - DNA, 85 bp, Homo sapiens; identical to SEQ ID NO: 93640
  chr5:180041104-180041189
  Hypo

SEQ ID NO: 125472 - DNA, 36 bp, Homo sapiens; identical to SEQ ID NO: 93641
  chr5:180042128-180042164
  Hypo

SEQ ID NO: 125473 - DNA, 247 bp, Homo sapiens; identical to SEQ ID NO: 93642
  chr5:180046700-180046947
  Hypo

SEQ ID NO: 125474 - DNA, 30 bp, Homo sapiens; identical to SEQ ID NO: 93643
  chr5:180047720-180047750
  Hypo

SEQ ID NO: 125475 - DNA, 252 bp, Homo sapiens; identical to SEQ ID NO: 93644
  chr5:180052859-180053111
  Hypo

SEQ ID NO: 125476 - DNA, 252 bp, Homo sapiens; identical to SEQ ID NO: 93645
  chr5:180057419-180057671
  Hypo

SEQ ID NO: 125477 - DNA, 1293 bp, Homo sapiens
  chr5:180075791-180077084
  Hyper
tcctcagctggccttcgaggcccctgtcccctcaaatccggggacccctggccttccgccccttctgcggcgctgacagcccgcgattcgcctcctcaagattcgtctcaagtgccagcgtgcacctgcacccgtccgcctcgggcgcgcggtggtccccggcccctgtccccgccgtcgccggccacggggagggggaagcccgcctcgagcgccctctgggggaccgaccgcgagcggaggcgctgggcgtcgggaagtgcgcacccaagtccggggcccggccgggatggatctccggcgcgcgtgggtcgggacggcgcggcgcggggaccccgcggggaagcgagtaagggcgcgaaggatccgggctcagcgcgcagcccggcagggcccggctccgaggacgcggagccaccgacggagacgcggattcaggggccgggagagctacccctgcgccgaggcgcggcccggccgccctggccctgacccggctgcggtccccgcccgccccttcctcatcccgaggtcccgcgccccaagcgccgtgctcccctcaggcgtccgcgcaccagggccaccgtgtcccccgcccgtacccggcggagcggtctcagcgcccgccccaggtgcgcggtaccccctccccggccagccccacgctcgggcgggtggcccgttcgccgcgctcaccgtccaggagtcccaggcagagccacagtcgcaggcacagcgcggcgccccgctgcatctccggccgctgcgcgtgggtccgacccgagcggccgcggctcggggctgaaagtgtccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcgggtaacgcagacggtctcgcgatgcgctccggaggtgatggagcctggtgggcaaaggggagcaaaatgcggcacgcgctcttttccgtcctttctttccatcggtaaaatctagactaaacaagaaagcaatccttgtaaaaatagtatgttacatctttgaaaatagtggcaccagccggcgtaacatagggagacccagtctcaaaaataaacaagcaaataaataaaataatacgccgagcttggttgtgcgcgcctgtaatcccagcttctcggggg

SEQ ID NO: 125478 - DNA, 744 bp, Homo sapiens
  chr5:180100588-180101332
  Hyper
cctgaggcgggaactcgggtttttaaggcgtttttgtcgcttccagctcggtttcccctgtggtcagttggagccagggtggggaatctgcagcttgcagaggggaccactgcgcctcctgcctgaggcgggctggggggtcgttgtcctcgcagcgttaaggcgagtctgggacaggaccccggcaccccctccggatctgtggcatcctccaggactccggcgcaggacgcgctccaggagccgctccttcagggcctccggtgcgcgcagtccgggcgccggacgagctcctttatcagaaagggcagccgcagagcccgcgtgtgcgcgatgtggctgcgggtggggagcgggcggcgggcccgggacaccgcggccactgttctagccccgcctgggccgcctgaccgcggctccgctgcgccgcagccccgcgcccctctggctcctgttcccgggcgcggggagaaggcggcggggcgcgcctgggcccgcgcgggtgcgaacgcgaggtctttcctgggtgctcccaggtcggaggattcccagggcgggggccatcagggtggcgaggaaccggcagggaccagcctccgctaggaccgcgctcgtggagcggggaggctcctggatcacgtcatctcctgctcctcacagatgcgggaggaaaaacggaggctcccagggcccggttaactcgctctcttgacaaagaacctcctggaccggactccagccagg

SEQ ID NO: 125479 - DNA, 196 bp, Homo sapiens; identical to SEQ ID NO: 93652
  chr5:180111784-180111980
  Hypo

SEQ ID NO: 125480 - DNA, 30 bp, Homo sapiens; identical to SEQ ID NO: 93653
  chr5:180159486-180159516
  Hypo

SEQ ID NO: 125481 - DNA, 23 bp, Homo sapiens
  chr5:180169497-180169520
  Hypo
cggaagtgcggggatgacaggcg

SEQ ID NO: 125482 - DNA, 225 bp, Homo sapiens; identical to SEQ ID NO: 93655
  chr5:180294196-180294421
  Hypo

SEQ ID NO: 125483 - DNA, 30 bp, Homo sapiens; identical to SEQ ID NO: 40699
  chr5:180326126-180326156
  Hypo

SEQ ID NO: 125484 - DNA, 64 bp, Homo sapiens; identical to SEQ ID NO: 93657
  chr5:180480238-180480302
  Hyper

SEQ ID NO: 125485 - DNA, 36 bp, Homo sapiens
  chr5:180486849-180486885
  Hyper
ggactggtggtgaggcgccctcgtggccgcgggact

SEQ ID NO: 125486 - DNA, 496 bp, Homo sapiens
  chr5:180527353-180527849
  Hyper
atctcccacccttgccgccctctggatccagcgtccaccgagcactttttccagttccttcattctgcgcgcgagtcagcttgctgtgtagggacagaagatgacgaagtgaattcctgcagcccgccgagctgttgctgtcgccctgggagcagggcacgctcttgaccatccactcgcagatctgcgacagcgcgagccgcttctccgccgagctctcgtcggccctggtgctgaggtcggcgtgggacaggctgcgcgacgcggtgcgacgggacgagctgcccctgcgctgctgcccggcggaggcggggtcccgggtgggtgctgcggcgcggcgtcccggcgtccgcaaaagtcctcgctgtcctgcagcaggctcgggttgctcatgaagtcggcgctgacgggcgggactggaggtggccgcgtgggacccgcgactggaaatccgggtgcacctccgccccccggggcgcttcggccttggggtccc

SEQ ID NO: 125487 - DNA, 34 bp, Homo sapiens; identical to SEQ ID NO: 93661
  chr5:180530753-180530787
  Hyper

SEQ ID NO: 125488 - DNA, 138 bp, Homo sapiens; identical to SEQ ID NO: 93662
  chr5:180531150-180531288
  Hyper

SEQ ID NO: 125489 - DNA, 40 bp, Homo sapiens
  chr5:180597061-180597101
  Hyper
cctgggcggaggccccgctccatcgcgcagtgccgtccac

SEQ ID NO: 125490 - DNA, 315 bp, Homo sapiens; identical to SEQ ID NO: 93665
  chr5:180601090-180601405
  Hyper

SEQ ID NO: 125491 - DNA, 256 bp, Homo sapiens; identical to SEQ ID NO: 93664
  chr5:180600774-180601030
  Hyper

SEQ ID NO: 125492 - DNA, 30 bp, Homo sapiens; identical to SEQ ID NO: 93666
  chr5:180631588-180631618
  Hyper

SEQ ID NO: 125493 - DNA, 366 bp, Homo sapiens; identical to SEQ ID NO: 93667
  chr5:180632859-180633225
  Hyper

SEQ ID NO: 125494 - DNA, 30 bp, Homo sapiens; identical to SEQ ID NO: 93668
  chr5:180644604-180644634
  Hyper

SEQ ID NO: 125495 - DNA, 51 bp, Homo sapiens; identical to SEQ ID NO: 93669
  chr5:180659766-180659817
  Hypo

SEQ ID NO: 125496 - DNA, 97 bp, Homo sapiens; identical to SEQ ID NO: 93670
  chr5:180661531-180661628
  Hypo

SEQ ID NO: 125497 - DNA, 37 bp, Homo sapiens; identical to SEQ ID NO: 40701
  chr5:180708092-180708129
  Hypo

SEQ ID NO: 125498 - DNA, 432 bp, Homo sapiens; identical to SEQ ID NO: 93672
  chr5:180708603-180709035
  Hypo

SEQ ID NO: 125499 - DNA, 30 bp, Homo sapiens; identical to SEQ ID NO: 93673
  chr5:180710021-180710051
  Hypo

SEQ ID NO: 125500 - DNA, 47 bp, Homo sapiens; identical to SEQ ID NO: 95468
  chr6:304250-304297
  Hypo

SEQ ID NO: 125501 - DNA, 336 bp, Homo sapiens; identical to SEQ ID NO: 95524
  chr6:348707-349043
  Hypo

SEQ ID NO: 125502 - DNA, 30 bp, Homo sapiens; identical to SEQ ID NO: 95583
  chr6:382294-382324
  Hypo

SEQ ID NO: 125503 - DNA, 2589 bp, Homo sapiens
  chr6:391173-393762
  Hyper
tctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctcgcactctcagtttcaccgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgctggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatccgaggctccttcccctgctcttcgttcctaaggggcccaagctcacggcggcctccggcgcggtgctcacccgctggcgcaggaggaggaggagctccacatttgggtcgctccgagccttgcgtgcggtggcctagccggcctggcgcggtccctgcctcccaggctccgcagctgtcgtcgccctctcccgcgccctccccgcctccgctctcccgggcctgctccggggtccggcggacgctctgcgcgcggaatcccccgtactggggctgcagcccccgcgtctgcgccacttgtcgtttgcagagcccacttagtgcgcgctagctgggcagggataggggtcctattcggggcgaagggtctggatgcgagcagagaaagcggagggtggaggaacccggggctgcgcccctggaacgcccggccgcaggcgaggtcctccgcgcgtggaggccgccaggggagtggaaactgacagagtcgcggggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcccggacgaccctgacacggcacgcgcgcgcttcgcagcctcaaagactccggggcctcgtggtcactggcgcaggggatcggggcggggtgcccggagtgcggtgcctcgtggctgaagggcagctcttctccccgcagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcggggcggacgggcgggcggcggaggcatcaggtggcgtcgccggagccgcaggaggaggaaaggaggcctcggctctcagcgggaccgcgggggccgggagccgggtcctgggcgcgtggaggctgcagggaaaccgctgaaggcccggccgggcccggggaagggcggccaaaggcttgaggggttttgcgcgttcgtccgtgcgttctcgtttccacgcaagcctcccgcccttcctccgggctcccgtctgccgcctccgtccgtgggtccccctcgccctctccgtgcg

SEQ ID NO: 125504 - DNA, 125 bp, Homo sapiens; identical to SEQ ID NO: 95600
  chr6:398564-398689
  Hypo

SEQ ID NO: 125505 - DNA, 169 bp, Homo sapiens; identical to SEQ ID NO: 95664
  chr6:434224-434393
  Hypo

SEQ ID NO: 125506 - DNA, 244 bp, Homo sapiens; identical to SEQ ID NO: 95688
  chr6:448910-449154
  Hypo

SEQ ID NO: 125507 - DNA, 30 bp, Homo sapiens; identical to SEQ ID NO: 95759
  chr6:508264-508294
  Hypo

SEQ ID NO: 125508 - DNA, 30 bp, Homo sapiens; identical to SEQ ID NO: 95844
  chr6:710606-710636
  Hyper

SEQ ID NO: 125509 - DNA, 257 bp, Homo sapiens; identical to SEQ ID NO: 95845
  chr6:711053-711310
  Hyper

SEQ ID NO: 125510 - DNA, 28 bp, Homo sapiens
  chr6:736009-736037
  Hypo
aacgtattagctggccgggcgtgatggc

SEQ ID NO: 125511 - DNA, 126 bp, Homo sapiens; identical to SEQ ID NO: 95873
  chr6:736749-736875
  Hypo

SEQ ID NO: 125512 - DNA, 237 bp, Homo sapiens; identical to SEQ ID NO: 94466
  chr6:1004078-1004315
  Hypo

SEQ ID NO: 125513 - DNA, 225 bp, Homo sapiens; identical to SEQ ID NO: 94700
  chr6:1271441-1271666
  Hypo

SEQ ID NO: 125514 - DNA, 92 bp, Homo sapiens; identical to SEQ ID NO: 94737
  chr6:1310870-1310962
  Hyper

SEQ ID NO: 125515 - DNA, 227 bp, Homo sapiens; identical to SEQ ID NO: 94738
  chr6:1311771-1311998
  Hyper

SEQ ID NO: 125516 - DNA, 30 bp, Homo sapiens; identical to SEQ ID NO: 30223
  chr6:1312754-1312784
  Hyper

SEQ ID NO: 125517 - DNA, 35 bp, Homo sapiens; identical to SEQ ID NO: 94742
  chr6:1313267-1313302
  Hyper

SEQ ID NO: 125518 - DNA, 65 bp, Homo sapiens
  chr6:1313997-1314062
  Hyper
cccggcggcggcccccgccaagccactccgaggcccggcggccggcggcgcgcacctgtactgcc

SEQ ID NO: 125519 - DNA, 40 bp, Homo sapiens; identical to SEQ ID NO: 94749
  chr6:1316770-1316810
  Hyper

SEQ ID NO: 125520 - DNA, 30 bp, Homo sapiens; identical to SEQ ID NO: 94750
  chr6:1317677-1317707
  Hypo

SEQ ID NO: 125521 - DNA, 1779 bp, Homo sapiens
  chr6:1378199-1379978
  Hyper
catattggaggaagtcggccggcagcttcaccctcctgcgggaaaatgcaaagtccatcaccaatagtcggtctaccgcagagaagtctgcaaatcccaggggcctggaactctaaaaaggccattcaagcctcaggtggactccacgtttctccatttccctgcccttccgcttttctttccttaacaagcttcttataacatttgcgtttgatgaggttcaagaggtcacttcccctccctctccgccctcctcgctcggcggagcggccgcgtccggacccctttctgaaggccgtccaagcccgcggtgcccggcggcggctgcgctgcctgaggtttcgcgcctcgcgcccggcggccgccgctgccggggccggtctcgcccacggtgaggtcagcctgcccttccctgccctgtgccgcctcgcgagtcctggagaggcccgcgccggcctcgaagcaaaagacgaccgccgaaacgcgaccgtttaccgcctgctttttccaagcaaaatttggagacaagtcccacccggggaagaacctggctaagggtcggacatggaagagaagacgctaaaacagaaattgcctccctgctttccacctgcagcttctagacgccgccctcggtgccacccctcgcggaaggcgttctcccacaccggggtcgccactgcgcccagctgcagaaagcactccgcacccccagcaattcggggcatggagccggcgggggtggcgcggccggggcctggagaagcagcgctgagtccgacaccgcccaccaggcccctcttggagaactagacaggcgacagcactcaggaccccggctgcggccggcgccgcggcagccacgcgctccagcccgcgtgcacctgcttcgctccgccgcgctcccggcttaagccggcggctccggggtcctgccccgacttttcgtactttctccctgctccgtgcctaactcaattcttaaccaaatcctgaaagcacaggagtttggttggggctgggacaggcgcagggacccaattctccccaagctctgcgggccacggccgaaaccaccccggggaaagccgtaggggcgcgccggcccacgcgggaccgagttcagaggactctgcaccgtcagtttcagggccgacgtttatagagcgcttcccacgtgccgcacgcggttctaagagcttggcttgtattaattcgtttaatcctcccagcaacactgttaggcattataatgatcccaatcgtagaagtcaaaaaaccgaggtgcagaaacaaagtaacttgttccagatcacgtaggtggtaagtgcagggtattctggagcaggagggagggtggaaagcacagaaaaaaaaaaatgaactgggaaaagcgttgacgtgcttagtatttcatactgcaggttccactttcagagccaggctgcgagcctacagggtagagtaggggtgccgggccccctggtgtcctggcgtactcggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacccgcgaggcgcccttgcgagctgcgcagtcgagttttctttccactgcactttcacgttctgccggatgg

SEQ ID NO: 125522 - DNA, 785 bp, Homo sapiens; identical to SEQ ID NO: 94806
  chr6:1381866-1382651
  Hyper

SEQ ID NO: 125523 - DNA, 457 bp, Homo sapiens; identical to SEQ ID NO: 94808
  chr6:1382993-1383450
  Hyper

SEQ ID NO: 125524 - DNA, 979 bp, Homo sapiens
  chr6:1383677-1384656
  Hyper
caaactcatctagggcgcgcccggagcttccccggcctctcttggcccatcgcgaacgagctcccctccccgactgggtcggcctcgggcgcctttcgccttcgcaggccgccggggttccgcggagggcttgtgtccctccctcccgccgccgcagcccgcccgaaggtcaggccgcatccggggcccggggcctttggccaggctgcggggaggggtggggttggggggctccccaaagcagcttctcggaggcggcgtcggggcgccctgaggtccctagtcggcctctgggcgccgagcacgttttatttatccccacagaggatgctggaggacaaaagaaatatttggacgtcagagctgatttatatttttggaagagctacgtttccttttctgaagagaagcgagcgcgccccatatcctgagctcggcggggaggacgagaggggagttttgatgcgccaggaagttcatctatcgcccaggcgctcaggacccggcgccccgccgagttcgccgccctcggaaatatttatttatttgggggaagggagggcagcggggaggagaccagccagacgggagaagaaagccctgcccgggctgggttgggacctccagggcgcttccccgcgcggccgcagccggccagcctctggtctcggttggagggcatcgcaggcgcggcctggcgacctccgggcgcctttggctggtgtcttccgtagccctcggcgcgcaccctcccgcgtgcagtgcccggagtgacctcttcaggccccgcgggcgcctcctgggtgggccccgcggcccctccaaccctgcccagcgtgtgtgcgcggcctagccatctttctccccagcctgggaaggcgggcgggaggaggggatccgaggccgggggccgcggagcaaaaggcacgcggacccctaaacgacccccgagcgttgccacagccgggagggcggaggg

SEQ ID NO: 125525 - DNA, 715 bp, Homo sapiens; identical to SEQ ID NO: 94813
  chr6:1384971-1385686
  Hyper

SEQ ID NO: 125526 - DNA, 35 bp, Homo sapiens; identical to SEQ ID NO: 30237
  chr6:1386121-1386156
  Hyper

SEQ ID NO: 125527 - DNA, 2570 bp, Homo sapiens
  chr6:1389006-1391576
  Hyper
acactaactggggtgcgggggtggggggaagaagtggaagcaaatgcaaccctaagtcccatgagatccaggtttccagagtctttgaaacttggcctaggtttctcagtgtaaatccctctgctcaaagttccgaaaacgtccacgatcgccagcggcccgcaaccctgcggcggcccccagtcgccctaacaattgtcggggagcctgcaggccctgccagaaagagagaggattggcacgttacctttgggcgtctggcaccccggcgtgtggctgagggcggcaaagtctaaacgaagttgacagatggagtcagtatcggccctggggagggcggccagggaggctccgagcagccgcacccgcagcagcaccactcggcccggcgggccaggaggaggaagggggcgcggaggggcggggctgggtcctgggatgggacgcggggcttgctgcggggggcaaacagaaagaatatttcatgaagtcagaggtggtcgagttttgcgaggggtgggggtcgtccccctggcagaaccggagtgagtctgtgatccctcaattggaaagagggtgagtgagggaaaggggaggaggccgcgagaggaatgaagagcgaggagaccctggagagcggggagcgagataagagagggaggcggccgccaggtcgggagggggaggagtgagcgcggcggcgcggagcgaggagggggcagggcggggtggggggggagggagggagggagggagcgaggagggcggccggggagggcgagggagggaggaagtccgagagacagagcgaggagcgctcctgaagggagacgtcgggctcgtccccggggtccaggccgcggtcccactcgcgggcgcagtcgcccggcgccggccgctcggccccgcggcctgggaggccgttgcgcaaggcagggcccgcggctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctccagggctggcggccactgccactcccacaaacagggaccccgaagctaggaggtctgagggcactgggaaaagcagatgctggggaaagccggcatcttattcgtgggagcagggatcagggtcttactgtcctcccagtatccctggccagcagccgaagcttcagaatt

SEQ ID NO: 125528 - DNA, 613 bp, Homo sapiens
  chr6:1392844-1393457
  Hyper
cagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccagcggcctcccgcggccggccttccctgggagcctcgcagaacccccgaccgagtctgggaacgcccgggggagacaatagctcgggcctgacgcccgacagggaccctctgcccttccttcctcgctgtcttgctcccgtccctataggatacccacccggccctgttgccatctccctggagcgccagcggtggaggcttcggaggagccggccggatgcaccgggaccccgcggggcctagttgggagcgcgccgcccactgaggcctgggggcccggcgaggcgcgggggtggccaaggcagtctccccggcacacagatcagcacatgtctacgcgcacacacccagcacgaccctccctcccccagcacaccccaagggccgcgccctccgctcctgggcctgg

SEQ ID NO: 125529 - DNA, 30 bp, Homo sapiens
  chr6:1393828-1393858
  Hyper
attgcggggacacggcggggctgaggccac

SEQ ID NO: 125530 - DNA, 49 bp, Homo sapiens; identical to SEQ ID NO: 94891
  chr6:1515653-1515702
  Hypo

SEQ ID NO: 125531 - DNA, 271 bp, Homo sapiens; identical to SEQ ID NO: 94896
  chr6:1524158-1524429
  Hyper

SEQ ID NO: 125532 - DNA, 666 bp, Homo sapiens; identical to SEQ ID NO: 94982
  chr6:1604877-1605543
  Hyper

SEQ ID NO: 125533 - DNA, 48 bp, Homo sapiens; identical to SEQ ID NO: 94987
  chr6:1610816-1610864
  Hyper

SEQ ID NO: 125534 - DNA, 933 bp, Homo sapiens; identical to SEQ ID NO: 94988
  chr6:1611198-1612131
  Hyper

SEQ ID NO: 125535 - DNA, 1036 bp, Homo sapiens
  chr6:1614162-1615198
  Hyper
cccctcccccagggtcgtaacctaatcgccgggaagatcgcagcggcgctggcgcgggtgtctcctcggggcaggcgggctgggggtggcctcacggccccgtttaaatctcgctgggctgtcgcggcgctaggtcccggggctgcctccagcttcctcgggttacagcctctttcggggcgggggaaggggagggggtgacggtagagactccaccgccagtctccaggagtttggtgtgatcgctccactttggggagcccggcgaggagctgggatttgcggacaaagggcccgcggccggagctggggtgtcgaggcccggaaggggagctgcagcaggtgactcacggccctgtccccacgggcgggctggcccagcccgaggcggagcagctcggccgccggagacggtaccgttctcgacgtgtccggtcggactctgtggagtagggggtggcgggtggagacccgcgcggcccacgcctggctttccggctggggcgtttctcgcaggcccggtcccttccgagtcgcgcccgccccgacgccggcctcctggacgccgctcgcgacggcaacgctctccagctaatgagctgtaattacccgcggcggcgcggggcccggcttcggtttgcgtttggagctccttcctccccacacccccctccccagattagccccggcctccgcggcctcctcctgaaattagtcgttggagaaaagcgagtcaaagggagacccctgttagtttcgctgggttcctcgcgggctgggtcggggtgccgggaagcgcgcgctgagggagggtggcaggcgcgcggtgccggggacggggacggggcggggggcgccgagccgggagaagcgccctcggggctccggccgagaagctcggaggagcccgctccctcgcccggtcaccccgcgtctccgcctggcgccgcagggccccgccgagctctcacttcctcctcgctggcctcctttgttgtgaagacgcacgtgtgtttaggagcgcagctggggtgga

SEQ ID NO: 125536 - DNA, 83 bp, Homo sapiens; identical to SEQ ID NO: 95018
  chr6:1619887-1619970
  Hyper

SEQ ID NO: 125537 - DNA, 33 bp, Homo sapiens; identical to SEQ ID NO: 95030
  chr6:1625026-1625059
  Hyper

SEQ ID NO: 125538 - DNA, 572 bp, Homo sapiens; identical to SEQ ID NO: 95031
  chr6:1625119-1625691
  Hyper

SEQ ID NO: 125539 - DNA, 30 bp, Homo sapiens; identical to SEQ ID NO: 40708
  chr6:1637278-1637308
  Hypo

SEQ ID NO: 125540 - DNA, 46 bp, Homo sapiens; identical to SEQ ID NO: 95104
  chr6:1658547-1658593
  Hypo

SEQ ID NO: 125541 - DNA, 30 bp, Homo sapiens; identical to SEQ ID NO: 40709
  chr6:1708613-1708643
  Hypo

SEQ ID NO: 125542 - DNA, 175 bp, Homo sapiens; identical to SEQ ID NO: 40710
  chr6:1726684-1726859
  Hypo

SEQ ID NO: 125543 - DNA, 155 bp, Homo sapiens; identical to SEQ ID NO: 95277
  chr6:2244329-2244484
  Hypo

SEQ ID NO: 125544 - DNA, 21 bp, Homo sapiens
  chr6:2247175-2247196
  Hypo
actgagcaagccgggcgcagt

SEQ ID NO: 125545 - DNA, 30 bp, Homo sapiens; identical to SEQ ID NO: 95279
  chr6:2376070-2376100
  Hypo

SEQ ID NO: 125546 - DNA, 30 bp, Homo sapiens; identical to SEQ ID NO: 95284
  chr6:2450689-2450719
  Hypo

SEQ ID NO: 125547 - DNA, 30 bp, Homo sapiens; identical to SEQ ID NO: 95289
  chr6:2510157-2510187
  Hypo

SEQ ID NO: 125548 - DNA, 81 bp, Homo sapiens; identical to SEQ ID NO: 95360
  chr6:2684354-2684435
  Hypo

SEQ ID NO: 125549 - DNA, 68 bp, Homo sapiens; identical to SEQ ID NO: 95368
  chr6:2709559-2709627
  Hypo

SEQ ID NO: 125550 - DNA, 72 bp, Homo sapiens; identical to SEQ ID NO: 40713
  chr6:2737187-2737259
  Hypo

SEQ ID NO: 125551 - DNA, 510 bp, Homo sapiens; identical to SEQ ID NO: 95463
  chr6:2903047-2903557
  Hyper

SEQ ID NO: 125552 - DNA, 180 bp, Homo sapiens; identical to SEQ ID NO: 95464
  chr6:2920758-2920938
  Hypo

SEQ ID NO: 125553 - DNA, 30 bp, Homo sapiens; identical to SEQ ID NO: 40715
  chr6:2939086-2939116
  Hypo

SEQ ID NO: 125554 - DNA, 30 bp, Homo sapiens; identical to SEQ ID NO: 95466
  chr6:2964245-2964275
  Hypo

SEQ ID NO: 125555 - DNA, 68 bp, Homo sapiens; identical to SEQ ID NO: 95467
  chr6:2985307-2985375
  Hypo

SEQ ID NO: 125556 - DNA, 30 bp, Homo sapiens; identical to SEQ ID NO: 95469
  chr6:3053039-3053069
  Hypo

SEQ ID NO: 125557 - DNA, 104 bp, Homo sapiens; identical to SEQ ID NO: 95470
  chr6:3053334-3053438
  Hypo

SEQ ID NO: 125558 - DNA, 84 bp, Homo sapiens; identical to SEQ ID NO: 95471
  chr6:3065550-3065634
  Hypo

SEQ ID NO: 125559 - DNA, 94 bp, Homo sapiens; identical to SEQ ID NO: 40718
  chr6:3104457-3104551
  Hypo

SEQ ID NO: 125560 - DNA, 35 bp, Homo sapiens; identical to SEQ ID NO: 40719
  chr6:3225962-3225997
  Hypo

SEQ ID NO: 125561 - DNA, 50 bp, Homo sapiens; identical to SEQ ID NO: 95474
  chr6:3227693-3227743
  Hyper

SEQ ID NO: 125562 - DNA, 494 bp, Homo sapiens; identical to SEQ ID NO: 95475
  chr6:3228186-3228680
  Hyper

SEQ ID NO: 125563 - DNA, 326 bp, Homo sapiens; identical to SEQ ID NO: 95476
  chr6:3228921-3229247
  Hyper

SEQ ID NO: 125564 - DNA, 325 bp, Homo sapiens; identical to SEQ ID NO: 95477
  chr6:3229307-3229632
  Hyper

SEQ ID NO: 125565 - DNA, 358 bp, Homo sapiens; identical to SEQ ID NO: 30253
  chr6:3231580-3231938
  Hyper

SEQ ID NO: 125566 - DNA, 396 bp, Homo sapiens; identical to SEQ ID NO: 95480
  chr6:3285139-3285535
  Hypo

SEQ ID NO: 125567 - DNA, 48 bp, Homo sapiens; identical to SEQ ID NO: 95481
  chr6:3286048-3286096
  Hypo

SEQ ID NO: 125568 - DNA, 30 bp, Homo sapiens; identical to SEQ ID NO: 40721
  chr6:3298330-3298360
  Hypo

SEQ ID NO: 125569 - DNA, 297 bp, Homo sapiens; identical to SEQ ID NO: 95483
  chr6:3307198-3307495
  Hypo

SEQ ID NO: 125570 - DNA, 149 bp, Homo sapiens; identical to SEQ ID NO: 95484
  chr6:3328274-3328423
  Hypo

SEQ ID NO: 125571 - DNA, 52 bp, Homo sapiens; identical to SEQ ID NO: 95485
  chr6:3333103-3333155
  Hypo

SEQ ID NO: 125572 - DNA, 128 bp, Homo sapiens; identical to SEQ ID NO: 95488
  chr6:3361088-3361216
  Hypo

SEQ ID NO: 125573 - DNA, 197 bp, Homo sapiens; identical to SEQ ID NO: 40724
  chr6:3363773-3363970
  Hypo

SEQ ID NO: 125574 - DNA, 30 bp, Homo sapiens; identical to SEQ ID NO: 95501
  chr6:3405673-3405703
  Hypo

SEQ ID NO: 125575 - DNA, 30 bp, Homo sapiens; identical to SEQ ID NO: 95508
  chr6:3438520-3438550
  Hypo

SEQ ID NO: 125576 - DNA, 30 bp, Homo sapiens; identical to SEQ ID NO: 95520
  chr6:3471840-3471870
  Hypo

SEQ ID NO: 125577 - DNA, 30 bp, Homo sapiens; identical to SEQ ID NO: 95535
  chr6:3569703-3569733
  Hypo

SEQ ID NO: 125578 - DNA, 79 bp, Homo sapiens; identical to SEQ ID NO: 95539
  chr6:3593615-3593694
  Hypo

SEQ ID NO: 125579 - DNA, 132 bp, Homo sapiens; identical to SEQ ID NO: 95568
  chr6:3751602-3751734
  Hyper

SEQ ID NO: 125580 - DNA, 32 bp, Homo sapiens; identical to SEQ ID NO: 95570
  chr6:3752663-3752695
  Hyper

SEQ ID NO: 125581 - DNA, 153 bp, Homo sapiens; identical to SEQ ID NO: 95585
  chr6:3881645-3881798
  Hypo

SEQ ID NO: 125582 - DNA, 33 bp, Homo sapiens; identical to SEQ ID NO: 95602
  chr6:4020063-4020096
  Hypo

SEQ ID NO: 125583 - DNA, 33 bp, Homo sapiens; identical to SEQ ID NO: 95603
  chr6:4020336-4020369
  Hypo

SEQ ID NO: 125584 - DNA, 145 bp, Homo sapiens; identical to SEQ ID NO: 95617
  chr6:4135160-4135305
  Hyper

SEQ ID NO: 125585 - DNA, 35 bp, Homo sapiens; identical to SEQ ID NO: 95640
  chr6:4276412-4276447
  Hypo

SEQ ID NO: 125586 - DNA, 22 bp, Homo sapiens
  chr6:4334950-4334972
  Hypo
gtagacccgagctgttcctatt

SEQ ID NO: 125587 - DNA, 36 bp, Homo sapiens; identical to SEQ ID NO: 95700
  chr6:4647938-4647974
  Hyper

SEQ ID NO: 125588 - DNA, 389 bp, Homo sapiens; identical to SEQ ID NO: 95705
  chr6:4775154-4775543
  Hyper

SEQ ID NO: 125589 - DNA, 186 bp, Homo sapiens; identical to SEQ ID NO: 95707
  chr6:4804538-4804724
  Hypo

SEQ ID NO: 125590 - DNA, 33 bp, Homo sapiens; identical to SEQ ID NO: 95708
  chr6:4836425-4836458
  Hypo

SEQ ID NO: 125591 - DNA, 273 bp, Homo sapiens; identical to SEQ ID NO: 95709
  chr6:4853849-4854122
  Hypo

SEQ ID NO: 125592 - DNA, 30 bp, Homo sapiens; identical to SEQ ID NO: 95710
  chr6:4858773-4858803
  Hypo

SEQ ID NO: 125593 - DNA, 65 bp, Homo sapiens; identical to SEQ ID NO: 95711
  chr6:4874127-4874192
  Hypo

SEQ ID NO: 125594 - DNA, 83 bp, Homo sapiens; identical to SEQ ID NO: 95714
  chr6:4910864-4910947
  Hypo

SEQ ID NO: 125595 - DNA, 33 bp, Homo sapiens; identical to SEQ ID NO: 40728
  chr6:4920708-4920741
  Hypo

SEQ ID NO: 125596 - DNA, 101 bp, Homo sapiens; identical to SEQ ID NO: 95716
  chr6:4931677-4931778
  Hypo

SEQ ID NO: 125597 - DNA, 275 bp, Homo sapiens; identical to SEQ ID NO: 95718
  chr6:4951177-4951452
  Hypo

SEQ ID NO: 125598 - DNA, 197 bp, Homo sapiens; identical to SEQ ID NO: 95724
  chr6:5026576-5026773
  Hyper

SEQ ID NO: 125599 - DNA, 30 bp, Homo sapiens; identical to SEQ ID NO: 95760
  chr6:5084912-5084942
  Hyper

SEQ ID NO: 125600 - DNA, 908 bp, Homo sapiens
  chr6:5085637-5086545
  Hyper
gctccttccacggcccgaggagttagttaagtctccagaggggcccggttcggcccgagcaagtccaggggcgaacggcgtcatggagcccataggggcgcggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcccggggccgagcgccgcggccgagcgtctgcagcggcagcgcgtgtgcctggagcgcgtgcagtgctcgacggcctcgggcgctgaggtgaagggctccggccgggtgctcagctgccctgggcccagggccgtgaccgtgcgctacacctttaccgagtggcgctccttcctggacgtgccggctgagctgcagcccgagccgctggagccacagc

SEQ ID NO: 125601 - DNA, 85 bp, Homo sapiens; identical to SEQ ID NO: 95787
  chr6:5783294-5783379
  Hypo

SEQ ID NO: 125602 - DNA, 377 bp, Homo sapiens
  chr6:5851459-5851836
  Hyper
cgctgcacctcggggcgtgttctcccacccatctgtgctcaggcatcccttccctctcctctggattttgtttaggcctatttgcaatttcttaaaaaaaaaaaaaaatctaataaatagttggagcctgaaagagagctggccaatgaaacgccgcgttggggcattaccgcatcggtgaggccgcccattggctggcgtgccctgaggcgatggctgcgtttccccggcaccgccccgcgccggtgcccacgcgtcccgggcttcaggggagcacctgggaagcgctgggggtcgcgtgcccttggccggaggcctggtcacccgcaggccctgccatcctcggcttggccgctgctgcccgcgcgcctgtggcg

SEQ ID NO: 125603 - DNA, 181 bp, Homo sapiens; identical to SEQ ID NO: 40731
  chr6:5892797-5892978
  Hypo

SEQ ID NO: 125604 - DNA, 1253 bp, Homo sapiens; identical to SEQ ID NO: 95801
  chr6:5996021-5997274
  Hyper

SEQ ID NO: 125605 - DNA, 386 bp, Homo sapiens; identical to SEQ ID NO: 95802
  chr6:5997513-5997899
  Hyper

SEQ ID NO: 125606 - DNA, 2081 bp, Homo sapiens
  chr6:6003269-6005350
  Hyper
aagcctcaggcttggcgctctgtccttggtgggcgctcagcaaacactgctgaatgaatgaacgaatatagtccctggaagccaccagcagttaccgaaatggattgtttcattataaaaccgattgcctaccgtggactctgtattccgagtgagaccctcggatgcaccctctcccgccccgctggaaagagggcagcctggacgtcctgagacctggcgcggatgatgagtggtctggagaggagaaggccagaggccgggcggggtcacggatgagtctgcctgggtcacctccgcaaaggccaaatccacgaacctcgggcctctttctctcctcctcccctgtccgccactcggctccccagacacccttaacaacccacccgcccgccaaaaagcccgcctacactccggacggcagcggggagaggctgttcttctccaggtgccagccctgctgctgaaagtgagctcgccgcggcccggggctcctggccccagctcaggactccctgcagagagcaggcagggataaaagctgagcggcgggaggaggaggaggaggaggaaacacaggccgcacgaaggtccaagccccaagcccccaagcccccggcctctggacggccaaaccccgaggcgcgggactggaaggacaggtaccaggctgcgggcgcgcggctgtggccatctctttccgccctgaggccgacgaacccggctggaagctgagtgcctagcggcccaaagcagcccgggcgccgggagggcgccagagaagcacagcgttagggcggggaagaaagggtgaatctcagaatcgaaatccgcactggcgcccacgaccctgggcgccggcctggtcctcggcagctttctggcggctgcgcttgtgtgtgaatgtgtcccgggaggaccggacacctcaatcccccggcccccaacgcgggcgcctgtccgcgagcgccgggccagacgccgaagaggaaggtgaccgaacccgtagcagcttccgagagcgtacccgtttgcaaattgctgcaggaagagcgaggcgggccttgcgctttttaatccggaacgggaagcactggggaagggaccgaggttaacttcgacctccgctggggcagatacgtaaaccttctcaaacctccgagttcaccttacagcgaacattaaatacccttgcgactacaatactaacaaatcgaacactgacgtaaaatcttaagaataaacgaatctttgttctgatagagctcgttcaaaatggaaatacactccacacatcttcctctataacgcatgtcacaaatacagctttgcagagaagaaacgaaataaaataaagtccaatctccccgtccacgtctctccccaccccttgcctacacccccaaaactcagtggcgaaagaagcccctaaaatgcattgacattttttaaggggaattggggctcgccgggggcgggagcgctcttgtcacgttatcttcccaggcgctgctggagaagaccctgcacaccgcgcatgtgtgagtgtgtgctgtgtaaaataagtcgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaacccccacttttcttgccaaatgtcaatgatttgggacagctcccagccgtgaattaataaagaccgaggttctgttgcaggaaagggcagacattagggaacaaatacgttcaatttcaattccacagtcaacaaatagtcatttttggaccgaggttaatgtgttcaaaacgcgtccctcaggcacg

SEQ ID NO: 125607 - DNA, 129 bp, Homo sapiens; identical to SEQ ID NO: 95806
  chr6:6006283-6006412
  Hyper

SEQ ID NO: 125608 - DNA, 1098 bp, Homo sapiens
  chr6:6006674-6007772
  Hyper
aagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggctgcctcccgcctccagcctccagccgggctgagcggccacttacctatttgcaccgcgaggatcagtgaaatatatctgccgttcaacttaagtcccatcctacgtttagtcaaaccatttgcgaccgcagacctttaaatagttagtttagagaacgcgggggaaagccaaaaaataggcattgccaacaagttccgggagcgacagagactttatgcactgggaaggcagagggaggagagaaagagagggagcgaggaagagacagaaagagagagagagagagaaagagagagagagagagaggctgaggggggggggagagctgggaatggttcactccattagaagggggcggaggaagtacagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctcgattaattcgaaagcgctcctcggccgcccgccccctgcgcttgcctaccctctttttctccaacccagcagctgagctctgggcgcagcctggagcgcgtg

SEQ ID NO: 125609 - DNA, 617 bp, Homo sapiens; identical to SEQ ID NO: 95809
  chr6:6007832-6008449
  Hyper

SEQ ID NO: 125610 - DNA, 863 bp, Homo sapiens; identical to SEQ ID NO: 95810
  chr6:6008689-6009552
  Hyper

SEQ ID NO: 125611 - DNA, 30 bp, Homo sapiens; identical to SEQ ID NO: 14827
  chr6:6045657-6045687
  Hypo

SEQ ID NO: 125612 - DNA, 30 bp, Homo sapiens; identical to SEQ ID NO: 40733
  chr6:6055082-6055112
  Hypo

SEQ ID NO: 125613 - DNA, 40 bp, Homo sapiens; identical to SEQ ID NO: 95813
  chr6:6058547-6058587
  Hypo

SEQ ID NO: 125614 - DNA, 216 bp, Homo sapiens; identical to SEQ ID NO: 95814
  chr6:6180497-6180713
  Hypo

SEQ ID NO: 125615 - DNA, 30 bp, Homo sapiens; identical to SEQ ID NO: 95815
  chr6:6199350-6199380
  Hypo

SEQ ID NO: 125616 - DNA, 37 bp, Homo sapiens; identical to SEQ ID NO: 14828
  chr6:6367079-6367116
  Hypo

SEQ ID NO: 125617 - DNA, 180 bp, Homo sapiens; identical to SEQ ID NO: 95828
  chr6:6534755-6534935
  Hypo

SEQ ID NO: 125618 - DNA, 702 bp, Homo sapiens; identical to SEQ ID NO: 95829
  chr6:6546520-6547222
  Hyper

SEQ ID NO: 125619 - DNA, 71 bp, Homo sapiens; identical to SEQ ID NO: 95830
  chr6:6720969-6721040
  Hypo

SEQ ID NO: 125620 - DNA, 30 bp, Homo sapiens; identical to SEQ ID NO: 95831
  chr6:6745438-6745468
  Hypo

SEQ ID NO: 125621 - DNA, 198 bp, Homo sapiens; identical to SEQ ID NO: 40736
  chr6:6891420-6891618
  Hypo

SEQ ID NO: 125622 - DNA, 30 bp, Homo sapiens; identical to SEQ ID NO: 95833
  chr6:6921408-6921438
  Hypo

SEQ ID NO: 125623 - DNA, 219 bp, Homo sapiens
  chr6:7051702-7051921
  Hyper
agggcagcagccctgcggcggctcgggaagaacaacttgtgcgaactgggccgcgcttcccccgggcgctgcatccgccttccgagatgctggcagcccgggacggcctagcgcggccctctccttatttatccaccgagcacagtttccatggttccgccgccatccttccgcccccttcctcgcgcggagcccagcggcagtcgagggcctggctgg

SEQ ID NO: 125624 - DNA, 84 bp, Homo sapiens; identical to SEQ ID NO: 95846
  chr6:7120320-7120404
  Hypo

SEQ ID NO: 125625 - DNA, 30 bp, Homo sapiens; identical to SEQ ID NO: 40737
  chr6:7132823-7132853
  Hypo

SEQ ID NO: 125626 - DNA, 184 bp, Homo sapiens; identical to SEQ ID NO: 95855
  chr6:7204204-7204388
  Hypo

SEQ ID NO: 125627 - DNA, 30 bp, Homo sapiens; identical to SEQ ID NO: 95856
  chr6:7204910-7204940
  Hypo

SEQ ID NO: 125628 - DNA, 27 bp, Homo sapiens
  chr6:7237769-7237796
  Hypo
tttaagcgctcgcgttggggcttgcag

SEQ ID NO: 125629 - DNA, 38 bp, Homo sapiens; identical to SEQ ID NO: 95864
  chr6:7279451-7279489
  Hypo

SEQ ID NO: 125630 - DNA, 87 bp, Homo sapiens; identical to SEQ ID NO: 95887
  chr6:7543263-7543350
  Hyper

SEQ ID NO: 125631 - DNA, 30 bp, Homo sapiens; identical to SEQ ID NO: 95888
  chr6:7562793-7562823
  Hypo

SEQ ID NO: 125632 - DNA, 2866 bp, Homo sapiens
  chr6:7726255-7729121
  Hyper
tggctgccagcctgtcggttaccgcggggcggggagtcccggggctggagtgaggtacctgagccgggcgcgcagcagaaagcccacgttggccgctgcggggagcgcggcgtggagaggcgggagaccgaattccggcgccgccgccgcggccgctgctcggtgcactagcccccttccttcccatcctttctgcgagcgggtttgctgggcagccgggcgaccgccgaacggaaagcaagatcctcgccgcctccgcttgaggaggcgtgcggcgcgcggagattttgagtgggagcgacggtgcccgagagctcaggggcgcggagttcgtgagcgagaaggaagttaaacctcgcggaatagactggcatttcgggacgccttgtcgccgcagcctgggccctgcaacggggtaaacttcatggtggccctgcgatctggggaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctgggtaaggatttggggtaacgtaatgacgagaacatttcccccttttcagtgtcccgggcccaggggatggagtgagggggtggaggagctcccggcgcgcgggtcccgcctggtgcgccagagaacgcggggacaggcaggctgtgctcccgccacctgcgcggcggtgggcggcacatgcgctcccccgcgccgcgggcagggctgcgcgccgaggcccccagaggcggctggccggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataagctgacttagtttagcgcagacataggatggagggacgcgctgtcagcggacagatcatgggtgcactggctacgcccgggatggttgcagctgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctggg

SEQ ID NO: 125633 - DNA, 183 bp, Homo sapiens; identical to SEQ ID NO: 95899
  chr6:7764169-7764352
  Hypo

SEQ ID NO: 125634 - DNA, 30 bp, Homo sapiens; identical to SEQ ID NO: 95908
  chr6:7844836-7844866
  Hypo

SEQ ID NO: 125635 - DNA, 362 bp, Homo sapiens; identical to SEQ ID NO: 95909
  chr6:7911626-7911988
  Hypo

SEQ ID NO: 125636 - DNA, 39 bp, Homo sapiens; identical to SEQ ID NO: 95910
  chr6:7920126-7920165
  Hypo

SEQ ID NO: 125637 - DNA, 195 bp, Homo sapiens
  chr6:10113557-10113752
  Hyper
tgagccgctgataaccggccgactggggagcccgggagcccttgcggaggcgtgggctggctcgggtgcgcaggcctggcccagcgggggcgccgggagagccggcccaattatgatgttgggagggatgttgtgatcctcggaggcggctctcgctaacaggcaggggcctgggggtcccgaggcaaggccggt

SEQ ID NO: 125638 - DNA, 860 bp, Homo sapiens
  chr6:10381507-10382367
  Hyper
ggatgaaaggagagccgtccacccagcgaggggcttgtgtgccctagagggcgctgggccccgcgcgctttcctggctgtccccgccggctttccaccctccccaaagcccaggtgcccaccgtgggtcgctgcggcctttccccttcttggccaaatccgattacttcgcagcctgcagatggcatcgccggctaagggcagcctgcggcaggtccccgagcctgagcactcctcctatctggggcctgagaggacgctctgggctttttcccaggcccagggtgcgcggcctgctagcgcctttcgaggcacagtcccaagataggctcttgtccttcgacgcccccttggcacaagcgcactggcgccctccgctcaacccaccttgcctttggggcgggcttcaaccctgggaagacaggcctgggggaagcgagaggagaggcccgaatagaggttccggctcaatctttcccagacggaggcctggtgtttccagctcagttgcatcttccagccgcgggctcctggcccaaacagaatgtgtttgctttcacaccgggacggcaagcggagtccgcctcagtgagcagcgagctgcgcagtccggacgggtgtcgcccccagagactcgccagccgcccccagacactcgccagccgtccccatctctaatccaccgtccaggcccgggccctgggaagaccccggggacgcgctggagcccctgaagggggtcagggggaacaatgcccgaaaagggagcctccccgaccgccagtccaaaggaaccggggatgtggcagcgattgcgaggggcctaggttagggacacgctcttctcgctgggtcccaagc

SEQ ID NO: 125639 - DNA, 389 bp, Homo sapiens; identical to SEQ ID NO: 94494
  chr6:10382722-10383111
  Hyper

SEQ ID NO: 125640 - DNA, 347 bp, Homo sapiens; identical to SEQ ID NO: 94495
  chr6:10383727-10384074
  Hyper

SEQ ID NO: 125641 - DNA, 75 bp, Homo sapiens; identical to SEQ ID NO: 94496
  chr6:10384438-10384513
  Hyper

SEQ ID NO: 125642 - DNA, 1452 bp, Homo sapiens
  chr6:10384821-10386273
  Hyper
tgcttctgcatattgcgttggtcgtggttttgtttaaaaagacgtaagaagggaagagaaagactgagatgatggggagatggtatttgcttgtttcatcttttatttttaaaagtaaatagggaagggggaaggagggggagccgtggcgggcgctacgtctgcgagctgattactccccgtctgaaagcggctccatttcccgcacggtgggtaagtcctttatcgggggaagccccggcctcgcccgcagccattcctcgcctcgaggcgcgcgccgggccggggcgcgggagccgctccgcgactccgtaatgacccgggttcgccgcagctgcgccctgaccctttgtgatggcgccgatagcgctcggatgaaattatgtccttctccgggtgtgaaattaccatgtttattaattgagccagacattagctttaccttttctttttaagccgtgaaaatttgcgattcagggcaaatgattctccgacagacgctgggctccacatcccacccctcccagcccgcgccccctccggtcctcgcgctccccggccgccacgtcccgggcagttcaggaaagcttgctaggtttccacgccggaaagcccaaggagaaggagccagcaggcctctgagcgtgtgagcgcgtgtgcgtgtcagcgcgtacatgggggtgttttcctcttcgggaagtgttatcaaacagtaatagctaccctcgactccgaatcacagcattccccccagaattcctgatcagtaaaacccaaatcgttttcaagacaaaggagcatcaatcagcgacaaagacagatttaacgtattaaatctttattaaagtgaagtcattcttattgaaatgatgtattgggtgtgcagaaagattggatttttttttttttttttttttgacaatgtgtaaaatggagatggtggcggagagcttgcgccgcgtcttgccctgattgttctgggctgggattggattactgggactgcccagggtcccgcgccaggaaacaccaccttggactacagggaagagactgatctccctcctcctgccggcccccacgttgatttcccgagaaacaagcgtgtcccaggtcttctcaaaaacttccctccttggtctccgcattagggaaactgaggtactgctggcatggctgtccatacgtttgctaaatcagctactccagaggcctagagaagggagggaacgccctgggttttccagaacaagacacagatctctccgtagcctaaagaaagtccttgcgccccaggtctgaaagccaaggggagcctgtgtttgctcccagcggggtcgccggccgtctccacaacccttgcttcctacaggcagaattgaatgcaggagctggctgtcttcccgcctggggtgggctctcaattcaactggacctcgggtcctgtcaagg

SEQ ID NO: 125643 - DNA, 1547 bp, Homo sapiens
  chr6:10389909-10391456
  Hyper
ctccacataagcagtcgatttctgtggtttcaaagaaaaaaaaaaaaaagatgaaacatgtcttctctttgagggtgacctttgacctttctttccaatacacctgacacaaagggcttagaaaagacccgtttcgggtgcggggtgctgatgctgcttttttgttgttcgtttgcgctcgcgctcgctctcgctctctctctgcatccccctcaccccctttctcggagactgaactaagtgaaaagttgtttcaataatcgcagctctctgctccgccagggccgagggaggcgggcggaacacggagggtgttttgttaaatgctcccgtcgttcgcaggggctgggacttgataaaaggagacagttttctgaaaagatttgattgaaatggcgtgtgccagggctgatgggagccagcgagggacaaagcgccgagaatccatggacactcgagcaattatgcctccacgctgaaggtggattagcgcgctggaaagaagcatatgtttggcccggggcgacacttccccccggctgagcttagagaatgggagcgcggagagcggctggacccggaatatcaactatctgcgaagcccccccttctagcccaactccgccagcctccccgcccccgccggggaaaagtcggagtgcatttttacaaagatgagaggagaagagagggctaggggaggagcgggcagggaggggagtaggtgcctagaggtgcaaatggccctgggatcccccaggagcggccctccaggctctcctctctggcgatcccgagggcgcgtccgtccttgggtgtggaaacccagagggggtcaaataaatgctcccctatggaatttcccactgctaaggtagttcggtccaggatgcccgctcaacgcgtattggaaggtcagccgaattgttgcaatgaaacaaggttttaatgactaaagatgcaagtgcctaaaaggttgcgttgggcaggaggcgcttggagggcagcgcgggttcccagccattccttgggtccaggtcgaggaaggcctcgggagacgagtcccacagtgagatatttgatgaaatgggtcggggctggaaagctcggacaggccgcatgggagagaaagggtgcgggtgcggcagtcggatccccacgcagctctatctgcttagacacccgggcgagggatgctttgggagtttggagccagaaagtttcccagaccctgcctccagtcattaattaaagcgcccttcccgtggaaaaaaaaaaggcccttaaaactctgacctggagcctcccggctcttcctcactgcacccgcaagcgcgctaagggagacgggaggcacaagcaagtcccaaacctttctctgggttttactgcagtttaattgggtctatcctggacgcgagtgccggtggccgctgcccaggccgtccacatttccctccctggctgtccttcgagcccctaccagtccttcctctccctgccgcccaagcccaggcaagactcgaaccgcccgtcccacacaatct

SEQ ID NO: 125644 - DNA, 44 bp, Homo sapiens; identical to SEQ ID NO: 94501
  chr6:10404465-10404509
  Hyper

SEQ ID NO: 125645 - DNA, 111 bp, Homo sapiens; identical to SEQ ID NO: 94502
  chr6:10404879-10404990
  Hyper

SEQ ID NO: 125646 - DNA, 504 bp, Homo sapiens; identical to SEQ ID NO: 94503
  chr6:10410444-10410948
  Hyper

SEQ ID NO: 125647 - DNA, 783 bp, Homo sapiens; identical to SEQ ID NO: 94504
  chr6:10411253-10412036
  Hyper

SEQ ID NO: 125648 - DNA, 299 bp, Homo sapiens; identical to SEQ ID NO: 94505
  chr6:10413015-10413314
  Hyper

SEQ ID NO: 125649 - DNA, 348 bp, Homo sapiens; identical to SEQ ID NO: 94506
  chr6:10414201-10414549
  Hyper

SEQ ID NO: 125650 - DNA, 508 bp, Homo sapiens; identical to SEQ ID NO: 94507
  chr6:10414821-10415329
  Hyper

SEQ ID NO: 125651 - DNA, 447 bp, Homo sapiens; identical to SEQ ID NO: 94508
  chr6:10415389-10415836
  Hyper

SEQ ID NO: 125652 - DNA, 260 bp, Homo sapiens; identical to SEQ ID NO: 94509
  chr6:10416118-10416378
  Hyper

SEQ ID NO: 125653 - DNA, 633 bp, Homo sapiens
  chr6:10417158-10417791
  Hyper
ctgagcacaattcctcggctgaaccgggctggaggcttggcgccgccctccgtccagaaaatggtcgactttccagggctagaccctgcagggctgtcccagcctgtcgccagtgcagtggtttgaagtcaggatctgggctgccaggagcaccgacaccctcccagcagcggccatagcctgagcaggccaaaccctaggcctgagagcatgggtttttacactccgtagacgtcgccgcggtgtgcttaagggaactccaagtttcgctttcttgccctctgcgggcttggaaaggccgccctccatcctctgccaccccatttcaacccccgtttccacctccccgctgccccgcgcccaacagatctccggctccgcacccgctggggctgctaaactgttgttgtattcccgccgagggcgccattgaggtgcagattgggacctgccggctctggactgccgcccccggtgtaggcgctgatgaaaggcccgggcgagcgccagggtcgcctctggagccagccgagctgcatttatgccagcgtcattaccacgctaagtcgcttcattgcatgtcaatgctccggcggggccagaaccccgggacagcagcgccaggcctggggt

SEQ ID NO: 125654 - DNA, 1191 bp, Homo sapiens
  chr6:10419077-10420268
  Hyper
tctcctacagaaacacgctgcctccgcgacccagccatctggacccctttccattcttcacacatcctagatctcccgaaatctgggggtaccaagagagacaggtgcaccagaacctgtccaacactcaaccctggggtctagggcgaggccgcaggcgcagcaggctgaaaaccttcaccgccgcgcaccacaaccccaggccttctccctccccccttccgaattagtcatcctcccaagtttctacttgaggtgggaggggggtgggggaaacggccacagcacaaaccacaagtgacccaccaggccacctgtggagcgtgcgccggacttccccggcgccgggccccgcgggctgcgcgctttgcgcccagcaccgcagtcgctgcctgcgcccgtttttcctgtcttcgctgtctcctgggagctctcctgggcgctgccaggcgcgcctcacctacgactcccctgccctgggccacggcgcttcctctcctcctccccgctccggccccctcccctactccacccctgcccacctcaaccccagccaaggcaaaccccccgtacctgccagtcccccattttggcaagtatggacatcgcggctctgcgctcctggcgactggtccccgccgggcatgggctggagggctcggtcgggccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaaccgaagctgactgactgctggatgtgctgggtgcgatgcgagtgtgagtgtgttttcgcactccagtggtggggcatcgacaagctcgacccatggctagcctcccctcggaactttcgaactgggggagtctccactcccgggtgggggtcgggggttggggaagggctagactgctagaagcgtccagaccccatgatccccgcgcacctggacacagtggggacaggtcgccgtccccgcctccccacccgcccacgaggtgca

SEQ ID NO: 125655 - DNA, 365 bp, Homo sapiens
  chr6:10420718-10421083
  Hyper
ctttaaaagaagccacgggatttggggctcccggagccgcacctggccaggagggaggtgagggtgaggagattggcctcgggccacactctcccagagacggtgccagtcccattccgcggctatgagatcgaattgtcctgggtctaggcctgggacgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaaccgtgcccgagagcctccgacccctgggccct

SEQ ID NO: 125656 - DNA, 1351 bp, Homo sapiens
  chr6:10421356-10422707
  Hyper
ctggctttttccagacggtggaaatagggcggtgactaacttttcagagtggaagacacgcacgaagggcgcacctgcagctctccgggattcaggcgggggtcgctgtgctctcttaaaagtgagcggcggtttcagcctgccaccgcttcgcctcgccagctcggaggaaactctggctggaggcgacctcgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcactagctaacagggcctgggacactgagccgtgtcgcaaacttttctgt

SEQ ID NO: 125657 - DNA, 169 bp, Homo sapiens; identical to SEQ ID NO: 94518
  chr6:10423918-10424087
  Hyper

SEQ ID NO: 125658 - DNA, 1575 bp, Homo sapiens
  chr6:10425382-10426957
  Hyper
agggaaagtctgcctcgatctgtagcagagttttgggattgactttctaaactgcagccactcctcatctttggccttgtgaaaaacttgagaccccggctttatcagtcccccttttgaaaaacagggcgtgtctcagccctaggtatgcaaagctaaacgtctcaaaccgctctgcattcgaattagccaacttaagaacaagtccaacagcactgctaagcaagagcctaataactcagcgtttcgcgacatctcttggcggcgttgaccgtttgcccgggacactggtttagaagcacggcatagggtgtctctacatcttagaaatcaagacagcctctaggttagaataaagtttactctggactgggcataactccactccacctctgcgattcttcttctcgtttcccgtcttctgtcttttctttcctcccttcccaactcctagcgcgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccctttgtgcaggcccggaagtgtccgcccggttttcccactgcctggaggggcccagggtcgcggatagactcggacaaggctccgtttactttcagtttgtcttagttgactaatggcgggactggttgtaatgcgtgctctgagattt

SEQ ID NO: 125659 - DNA, 265 bp, Homo sapiens
  chr6:10528476-10528741
  Hyper
agtcatatgccatgtcgtatagcatacccagccaatggggagagcgaggtgtggctgtggaaaaagacagggttaagcaatttttttaaagcactacatatttattgatagaatatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctg

SEQ ID NO: 125660 - DNA, 42 bp, Homo sapiens; identical to SEQ ID NO: 94534
  chr6:10541735-10541777
  Hypo

SEQ ID NO: 125661 - DNA, 30 bp, Homo sapiens; identical to SEQ ID NO: 94541
  chr6:10591675-10591705
  Hypo

SEQ ID NO: 125662 - DNA, 78 bp, Homo sapiens; identical to SEQ ID NO: 94542
  chr6:10595774-10595852
  Hypo

SEQ ID NO: 125663 - DNA, 30 bp, Homo sapiens; identical to SEQ ID NO: 94549
  chr6:10659521-10659551
  Hypo

SEQ ID NO: 125664 - DNA, 41 bp, Homo sapiens; identical to SEQ ID NO: 94556
  chr6:10776289-10776330
  Hypo

SEQ ID NO: 125665 - DNA, 559 bp, Homo sapiens
  chr6:10881854-10882413
  Hyper
gactcttcaagaactcgaatgccattctccctccttcggatggacagcgccccgcgtgcccgcacacacccggttcacttacctgaggcatctgcggatcgttgatgtcccagctgagctgcatcccgtaggagcacacgccgaccgcttcctgcaccgcggccgccggcatctgcccaactcgctcgcgctttccgcccagggttctgaaaaatagaagaaaaaaggacaggtgcgccaggtgggttttttttcttctctttaaagaagaaagtggggtgtgtgaaggggaggtgcagagagagagaaagagagagaggctgtttagatatctggaagctggggacaatggttatggacccgggcggggccttgtccttggccgcggtgctgaacgttctccacccgaacggcagcatcgacctctggcagctgccccctcctttataaagatatacctccggggggctccgccctgtctcgcctacctcgctagcgcccacgctccaggggccggtcgccccctccaccacagtcccaggaacggaggtggaggtta

SEQ ID NO: 125666 - DNA, 385 bp, Homo sapiens
  chr6:10883008-10883393
  Hyper
ttgggcctccactgccggctcttcccctaactattgtgagtgtctcgcagtcttggctctgctgtttgggacgtgccagggtgcgccaagcctccgcgtatgctcgcgagcccaggcgccttcacgctcccggggacttcggagggacctggccctgcaggaacggagtcctacaaagtgaacctggaggaggtggggggcggaaatgagcccggggtaggtgggagcctggggtaggtgggagcctggggaaggagggaaaggggagaggggaaaagtcccaaagaactcgctttctccactgctttggctccctctgggtctcagcttccttatctgtttatctgttaaataagaggttgtggttcggcgagctctcagttgc

SEQ ID NO: 125667 - DNA, 799 bp, Homo sapiens
  chr6:10886917-10887716
  Hyper
attacaggcgtgagccaccgcgcctggccgcccctctggctttttaaggcggggcaaaaacttggaacagctaccacaaagcgaacgcctatctgtttggaatttcgcaaataaggaacgtttaaatgacgtagttcacatcctttgagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcggtgagtgacccccgaagggcccggaccttctgtccacagtgctagggcgcgcgagggcgcggggtccctggggctcaggttctgccgccttgaggtgttcgctcagagaccgggtgctgggcatagtcccccgccacctccttgggtttgctcggagtgtattggcagcctgcggggagaccaggcagaatagaaacctcggatccctagctaaatagcgctcagggaaaggggaaccggagaattcgtgttcggaaagcaatgagatagttcttttctagttgctttgcgtattttcctagccggttttccagccctctttccaccttgctgcgtagaaagtgcaga

SEQ ID NO: 125668 - DNA, 1229 bp, Homo sapiens
  chr6:11043701-11044930
  Hyper
cacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggccgccgcgaaggaggggcggcttcctcgggcatcccgggcgcccggccccgtgcatgcaacaggggactgggcgcgagcgggcgcctcgaggtgccggggcgggaccggggagaggggaccgagacaaagttcccgagacccgcgggcctcgggccgacccgcgcgcccccggcccaaacgctcagctcccgctccccaggcccgcgcggacccggcccctccgagggtagcgggttccagcggcgaacccgcagcgcccgcgccggcgcccgctcggccctttcccgcccggtgcgtgggtccaggagagaaagaaagcgcggcggtgtcggtggcggcgcgcggccccactcaccatgatccgcagcggctgtggcgcggcgacccgggcgggcggcgatgcgctgtccagggtagccgggtccctctgcccggcgctatctcggcgcccgcgccggttacccccacccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaatacccacccgctgcccagatcgg

SEQ ID NO: 125669 - DNA, 30 bp, Homo sapiens; identical to SEQ ID NO: 94612
  chr6:11288375-11288405
  Hypo

SEQ ID NO: 125670 - DNA, 17 bp, Homo sapiens
  chr6:12194739-12194756
  Hypo
aaaggacaaacaggccg

SEQ ID NO: 125671 - DNA, 48 bp, Homo sapiens; identical to SEQ ID NO: 94668
  chr6:12222846-12222894
  Hypo

SEQ ID NO: 125672 - DNA, 142 bp, Homo sapiens; identical to SEQ ID NO: 94669
  chr6:12287999-12288141
  Hypo

SEQ ID NO: 125673 - DNA, 349 bp, Homo sapiens; identical to SEQ ID NO: 40747
  chr6:12288379-12288728
  Hypo

SEQ ID NO: 125674 - DNA, 30 bp, Homo sapiens; identical to SEQ ID NO: 94698
  chr6:12626382-12626412
  Hypo

SEQ ID NO: 125675 - DNA, 164 bp, Homo sapiens; identical to SEQ ID NO: 94708
  chr6:12749336-12749500
  Hyper

SEQ ID NO: 125676 - DNA, 649 bp, Homo sapiens
  chr6:12749820-12750469
  Hyper
ccctcctcccccttccgcctctctccctctccctccgtctccttctccctctcagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcaggtaagaacgcccctggcgccgcgcccccgcccccgccctgctccctccctccccggctgttgagcccccgcccctcccgggcgtcctccccgccgccccccgcagtcgggcgctcagcactcgcgctctttgtgtctccggtgcgcagagggcgtgtgtgcgagctacggggtgggggagggcggcgcgtgcagccccacatccgcccgagtcccacgcgggcttccccggcacggggaggaggaagtgctgtcagtgaccacagtgatcccgggaataacccggagcccgggccgcgcgcccatgcgcaggctgcgggcgcggggtctggcgaggctccccgggcgaggttggctggcgcggctactacggggtggaacttgttggtgacattcagactctgttggctttgacgggttgacgccgccgctgcggtgttggagtggg

SEQ ID NO: 125677 - DNA, 30 bp, Homo sapiens; identical to SEQ ID NO: 94711
  chr6:12770884-12770914
  Hypo

SEQ ID NO: 125678 - DNA, 506 bp, Homo sapiens; identical to SEQ ID NO: 30320
  chr6:13013570-13014076
  Hyper

SEQ ID NO: 125679 - DNA, 30 bp, Homo sapiens; identical to SEQ ID NO: 94729
  chr6:13044971-13045001
  Hypo

SEQ ID NO: 125680 - DNA, 178 bp, Homo sapiens; identical to SEQ ID NO: 94739
  chr6:13118018-13118196
  Hypo

SEQ ID NO: 125681 - DNA, 145 bp, Homo sapiens; identical to SEQ ID NO: 94751
  chr6:13180876-13181021
  Hypo

SEQ ID NO: 125682 - DNA, 159 bp, Homo sapiens; identical to SEQ ID NO: 40748
  chr6:13288514-13288673
  Hypo

SEQ ID NO: 125683 - DNA, 51 bp, Homo sapiens; identical to SEQ ID NO: 94759
  chr6:13293172-13293223
  Hypo

SEQ ID NO: 125684 - DNA, 207 bp, Homo sapiens; identical to SEQ ID NO: 94778
  chr6:13488388-13488595
  Hyper

SEQ ID NO: 125685 - DNA, 18 bp, Homo sapiens
  chr6:13510401-13510419
  Hypo
tggagtacaatggtgcga

SEQ ID NO: 125686 - DNA, 17 bp, Homo sapiens
  chr6:13510479-13510496
  Hypo
accgacttcaagaatga

SEQ ID NO: 125687 - DNA, 105 bp, Homo sapiens; identical to SEQ ID NO: 94792
  chr6:13767864-13767969
  Hyper

SEQ ID NO: 125688 - DNA, 22 bp, Homo sapiens
  chr6:13829036-13829058
  Hypo
cctactgggggaactcgccccc

SEQ ID NO: 125689 - DNA, 699 bp, Homo sapiens; identical to SEQ ID NO: 30322
  chr6:13924890-13925589
  Hyper

SEQ ID NO: 125690 - DNA, 30 bp, Homo sapiens; identical to SEQ ID NO: 94828
  chr6:14002445-14002475
  Hypo

SEQ ID NO: 125691 - DNA, 30 bp, Homo sapiens; identical to SEQ ID NO: 94829
  chr6:14140908-14140938
  Hypo

SEQ ID NO: 125692 - DNA, 156 bp, Homo sapiens; identical to SEQ ID NO: 40750
  chr6:14203256-14203412
  Hypo

SEQ ID NO: 125693 - DNA, 76 bp, Homo sapiens; identical to SEQ ID NO: 94834
  chr6:14281293-14281369
  Hypo

SEQ ID NO: 125694 - DNA, 30 bp, Homo sapiens; identical to SEQ ID NO: 40751
  chr6:14999193-14999223
  Hypo

SEQ ID NO: 125695 - DNA, 75 bp, Homo sapiens; identical to SEQ ID NO: 40752
  chr6:15073578-15073653
  Hypo

SEQ ID NO: 125696 - DNA, 21 bp, Homo sapiens
  chr6:15129502-15129523
  Hypo
acagtttcggccgggcgcggt

SEQ ID NO: 125697 - DNA, 30 bp, Homo sapiens; identical to SEQ ID NO: 94894
  chr6:15213893-15213923
  Hypo

SEQ ID NO: 125698 - DNA, 87 bp, Homo sapiens; identical to SEQ ID NO: 94895
  chr6:15223030-15223117
  Hypo

SEQ ID NO: 125699 - DNA, 37 bp, Homo sapiens; identical to SEQ ID NO: 94904
  chr6:15302352-15302389
  Hypo

SEQ ID NO: 125700 - DNA, 40 bp, Homo sapiens; identical to SEQ ID NO: 40753
  chr6:15456031-15456071
  Hypo

SEQ ID NO: 125701 - DNA, 40 bp, Homo sapiens; identical to SEQ ID NO: 94917
  chr6:15512658-15512698
  Hypo

SEQ ID NO: 125702 - DNA, 30 bp, Homo sapiens; identical to SEQ ID NO: 94941
  chr6:15802460-15802490
  Hypo

SEQ ID NO: 125703 - DNA, 185 bp, Homo sapiens; identical to SEQ ID NO: 94947
  chr6:15843746-15843931
  Hypo

SEQ ID NO: 125704 - DNA, 30 bp, Homo sapiens; identical to SEQ ID NO: 94995
  chr6:16140263-16140293
  Hypo

SEQ ID NO: 125705 - DNA, 182 bp, Homo sapiens; identical to SEQ ID NO: 94998
  chr6:16148438-16148620
  Hypo

SEQ ID NO: 125706 - DNA, 266 bp, Homo sapiens; identical to SEQ ID NO: 95016
  chr6:16197009-16197275
  Hypo

SEQ ID NO: 125707 - DNA, 25 bp, Homo sapiens
  chr6:16197335-16197360
  Hypo
cctaaggtggcgcagctggagttgt

SEQ ID NO: 125708 - DNA, 151 bp, Homo sapiens; identical to SEQ ID NO: 40755
  chr6:16218420-16218571
  Hypo

SEQ ID NO: 125709 - DNA, 145 bp, Homo sapiens; identical to SEQ ID NO: 40756
  chr6:16249815-16249960
  Hypo

SEQ ID NO: 125710 - DNA, 42 bp, Homo sapiens; identical to SEQ ID NO: 95033
  chr6:16288325-16288367
  Hypo

SEQ ID NO: 125711 - DNA, 192 bp, Homo sapiens; identical to SEQ ID NO: 95035
  chr6:16293373-16293565
  Hypo

SEQ ID NO: 125712 - DNA, 40 bp, Homo sapiens; identical to SEQ ID NO: 95036
  chr6:16295428-16295468
  Hypo

SEQ ID NO: 125713 - DNA, 154 bp, Homo sapiens; identical to SEQ ID NO: 95038
  chr6:16356093-16356247
  Hypo

SEQ ID NO: 125714 - DNA, 180 bp, Homo sapiens; identical to SEQ ID NO: 95039
  chr6:16359260-16359440
  Hypo

SEQ ID NO: 125715 - DNA, 41 bp, Homo sapiens; identical to SEQ ID NO: 95097
  chr6:16444348-16444389
  Hypo

SEQ ID NO: 125716 - DNA, 73 bp, Homo sapiens; identical to SEQ ID NO: 95253
  chr6:17102273-17102346
  Hyper

SEQ ID NO: 125717 - DNA, 30 bp, Homo sapiens; identical to SEQ ID NO: 95254
  chr6:17102637-17102667
  Hyper

SEQ ID NO: 125718 - DNA, 243 bp, Homo sapiens
  chr6:17281019-17281262
  Hyper
ccagccctaccccatcgccggctacagagcgggagccccgagccccagcgccgcgccgcgcggggagagaagcagctgttcccaacagctggggggcggcggcgcccggcgccccaggtgctgccgcggccaatcgcaggcgtccggcccgcccccctccccagccgggcgtcgacccccggcccgcgggggaagggagcagagaggtggagagctgtcctcggcactcgtcttccagatccc

SEQ ID NO: 125719 - DNA, 119 bp, Homo sapiens; identical to SEQ ID NO: 95257
  chr6:17282098-17282217
  Hyper

SEQ ID NO: 125720 - DNA, 19 bp, Homo sapiens
  chr6:17339508-17339527
  Hypo
acttcgtctcaaaaaaaca

SEQ ID NO: 125721 - DNA, 190 bp, Homo sapiens; identical to SEQ ID NO: 95259
  chr6:18035825-18036015
  Hypo

SEQ ID NO: 125722 - DNA, 405 bp, Homo sapiens; identical to SEQ ID NO: 95260
  chr6:18122677-18123082
  Hyper

SEQ ID NO: 125723 - DNA, 610 bp, Homo sapiens
  chr6:18277433-18278043
  Hyper
ttcctaaagagggtgcgtttgtggggaaggtgagtgcgcgcgcgcggagggagggccggccgcggagaggggccaaaactcttcggaatcagcagccagagaggctctgagggcgcccgcggggcggaggggagcggggcagagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagccgcggcgggcggcccacgggggatcagaccctcgggcatccgcgtttcccctccgccgtccgccggacccccacctcttctccaagctccactcccgacttttcttccccgcccccgggaagct

SEQ ID NO: 125724 - DNA, 34 bp, Homo sapiens; identical to SEQ ID NO: 95263
  chr6:18507305-18507339
  Hypo

SEQ ID NO: 125725 - DNA, 532 bp, Homo sapiens
  chr6:19691714-19692246
  Hyper
tagttgctgaaaagccggggccttggagctttcggatcctgcccgcctttcatcatgtaaacaaacgcatcagatttaaagctttcccataattgttatgctaaccttggagcgcaacctctccatttgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaaggggcgccgcgaagggccgtcatcttgttggaaaagaatgcagaaatgcccccctaaggctgaatgagcaccacttccacactcagggcgggggaggccgggggacgtgggagcggcgcgccaggagcgaggcgtccctggtgacagcgcgtcccgagggctctcccttttcccagagcgcataccaaaggcagactcctttgcaggctccacgagccccattcgcggtggaaaggggcgttccagactgcag

SEQ ID NO: 125726 - DNA, 397 bp, Homo sapiens
  chr6:19836792-19837189
  Hyper
aaagaaccccccccacgtttttgttttatttatattcccttcaccaaaaacctgcattcgattcggcattcttttccttctttttttttctacttttgctaagctttagcattttttaaaaagaaaacggaaaggctacacattccattccatcattatggtttcggcaaatgtgaaaaggcgaataatgaaacggaggagggaaatatagaacagaatgaacgtgccttcttgaacagcgcgtctttcttaaggcactggaatcccacggatggagtgatgggtggcggagggtccctgggcgccgtgctattaggagtggcagggtatccgcgagcagggcccaggcgctccctcagcagcctagtcgggataaggggggcggtggagagtgaat

SEQ ID NO: 125727 - DNA, 46 bp, Homo sapiens
  chr6:19837389-19837435
  Hyper
ccactccagaccccccgcccactcctccactcgggtagccggactc

SEQ ID NO: 125728 - DNA, 453 bp, Homo sapiens
  chr6:19838167-19838620
  Hyper
gctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggtgagaggccgggcgccggccgtgggcggacgccgcgggggatgggaggttggtggcgtggtggcgggacgcgggcgctcaccgtcctccgggcaggggcgggccaggaatgacagccccctccccctgctcctccgggctcccccgggccgccagcagccggccgggctcggcgagcgcgggtccgggagaac

SEQ ID NO: 125729 - DNA, 636 bp, Homo sapiens
  chr6:19838838-19839474
  Hyper
gacagcattctgtgccgctgagccgcgctgtccaggtgagcgcgcatttcccgtctcgggtggccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcact

SEQ ID NO: 125730 - DNA, 30 bp, Homo sapiens; identical to SEQ ID NO: 95266
  chr6:20057944-20057974
  Hypo

SEQ ID NO: 125731 - DNA, 30 bp, Homo sapiens; identical to SEQ ID NO: 95267
  chr6:20317888-20317918
  Hypo

SEQ ID NO: 125732 - DNA, 30 bp, Homo sapiens; identical to SEQ ID NO: 40761
  chr6:20691518-20691548
  Hypo

SEQ ID NO: 125733 - DNA, 95 bp, Homo sapiens; identical to SEQ ID NO: 95269
  chr6:20702857-20702952
  Hypo

SEQ ID NO: 125734 - DNA, 173 bp, Homo sapiens; identical to SEQ ID NO: 95270
  chr6:21587469-21587642
  Hyper

SEQ ID NO: 125735 - DNA, 268 bp, Homo sapiens; identical to SEQ ID NO: 95271
  chr6:21664923-21665191
  Hyper

SEQ ID NO: 125736 - DNA, 567 bp, Homo sapiens; identical to SEQ ID NO: 95272
  chr6:21665622-21666189
  Hyper

SEQ ID NO: 125737 - DNA, 131 bp, Homo sapiens; identical to SEQ ID NO: 95273
  chr6:21666457-21666588
  Hyper

SEQ ID NO: 125738 - DNA, 23 bp, Homo sapiens
  chr6:21687659-21687682
  Hypo
tgagactccgcctcaaaacaaaa

SEQ ID NO: 125739 - DNA, 30 bp, Homo sapiens; identical to SEQ ID NO: 95275
  chr6:21782706-21782736
  Hypo

SEQ ID NO: 125740 - DNA, 176 bp, Homo sapiens; identical to SEQ ID NO: 95276
  chr6:22149842-22150018
  Hypo

SEQ ID NO: 125741 - DNA, 180 bp, Homo sapiens; identical to SEQ ID NO: 95280
  chr6:24126308-24126488
  Hyper

SEQ ID NO: 125742 - DNA, 30 bp, Homo sapiens; identical to SEQ ID NO: 95281
  chr6:24438527-24438557
  Hypo

SEQ ID NO: 125743 - DNA, 30 bp, Homo sapiens; identical to SEQ ID NO: 40764
  chr6:24465059-24465089
  Hypo

SEQ ID NO: 125744 - DNA, 223 bp, Homo sapiens; identical to SEQ ID NO: 95283
  chr6:24494649-24494872
  Hyper

SEQ ID NO: 125745 - DNA, 30 bp, Homo sapiens; identical to SEQ ID NO: 95285
  chr6:24546740-24546770
  Hypo

SEQ ID NO: 125746 - DNA, 30 bp, Homo sapiens; identical to SEQ ID NO: 95286
  chr6:24602615-24602645
  Hypo

SEQ ID NO: 125747 - DNA, 29 bp, Homo sapiens
  chr6:24647342-24647371
  Hypo
aaaaccagctgggtgcggtggctcacgcc

SEQ ID NO: 125748 - DNA, 110 bp, Homo sapiens; identical to SEQ ID NO: 95288
  chr6:24761445-24761555
  Hypo

SEQ ID NO: 125749 - DNA, 150 bp, Homo sapiens; identical to SEQ ID NO: 95290
  chr6:25218431-25218581
  Hypo

SEQ ID NO: 125750 - DNA, 19 bp, Homo sapiens
  chr6:25311446-25311465
  Hypo
tgaacgcataagtaccttt

SEQ ID NO: 125751 - DNA, 126 bp, Homo sapiens; identical to SEQ ID NO: 95292
  chr6:25652379-25652505
  Hyper

SEQ ID NO: 125752 - DNA, 103 bp, Homo sapiens; identical to SEQ ID NO: 95293
  chr6:25668982-25669085
  Hypo

SEQ ID NO: 125753 - DNA, 30 bp, Homo sapiens; identical to SEQ ID NO: 40768
  chr6:25710967-25710997
  Hypo

SEQ ID NO: 125754 - DNA, 116 bp, Homo sapiens; identical to SEQ ID NO: 95295
  chr6:25727275-25727391
  Hypo

SEQ ID NO: 125755 - DNA, 146 bp, Homo sapiens; identical to SEQ ID NO: 95296
  chr6:25727916-25728062
  Hypo

SEQ ID NO: 125756 - DNA, 30 bp, Homo sapiens; identical to SEQ ID NO: 95297
  chr6:26018763-26018793
  Hypo

SEQ ID NO: 125757 - DNA, 384 bp, Homo sapiens; identical to SEQ ID NO: 95298
  chr6:26020891-26021275
  Hyper

SEQ ID NO: 125758 - DNA, 472 bp, Homo sapiens; identical to SEQ ID NO: 95299
  chr6:26021706-26022178
  Hyper

SEQ ID NO: 125759 - DNA, 30 bp, Homo sapiens; identical to SEQ ID NO: 95300
  chr6:26028765-26028795
  Hypo

SEQ ID NO: 125760 - DNA, 464 bp, Homo sapiens; identical to SEQ ID NO: 95301
  chr6:26033744-26034208
  Hyper

SEQ ID NO: 125761 - DNA, 30 bp, Homo sapiens; identical to SEQ ID NO: 95302
  chr6:26034546-26034576
  Hyper

SEQ ID NO: 125762 - DNA, 41 bp, Homo sapiens; identical to SEQ ID NO: 95303
  chr6:26047700-26047741
  Hypo

SEQ ID NO: 125763 - DNA, 27 bp, Homo sapiens
  chr6:26053446-26053473
  Hypo
cgtgagccaccgcgcccagcctttttt

SEQ ID NO: 125764 - DNA, 43 bp, Homo sapiens; identical to SEQ ID NO: 95305
  chr6:26067205-26067248
  Hypo

SEQ ID NO: 125765 - DNA, 370 bp, Homo sapiens
  chr6:26087615-26087985
  Hyper
gccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtg

SEQ ID NO: 125766 - DNA, 88 bp, Homo sapiens; identical to SEQ ID NO: 30339
  chr6:26088186-26088274
  Hyper

SEQ ID NO: 125767 - DNA, 353 bp, Homo sapiens
  chr6:26172018-26172371
  Hyper
cctgaaaaataacagcggtcatcctactcccggtgcggctatgcggccatgaaaaggagtcttggggccggtcgtgcccctccacgcaggctccctcatagggtcatcccatcaaccctcgccaaaaacgccggccccctcatagggccgtccggccacgcccctccgtgccctaaccacagagccacacgttacgccgccgccccgttacgcccatccggctcccgcatagggcgtcacgtacgtttaacgtcggcccggcgcgcgcgtccgggaggttgcccgtaggccgctaactggtggttcccagtccccgccgactcggcctctttcttctgcggccaccagatcgc

SEQ ID NO: 125768 - DNA, 95 bp, Homo sapiens; identical to SEQ ID NO: 95311
  chr6:26184021-26184116
  Hyper

SEQ ID NO: 125769 - DNA, 35 bp, Homo sapiens; identical to SEQ ID NO: 95312
  chr6:26184356-26184391
  Hyper

SEQ ID NO: 125770 - DNA, 691 bp, Homo sapiens
  chr6:26188753-26189444
  Hyper
cgccattgattactccagcatgggcgacacagcaagagtgaaaataaactttaatacactatcctcaccggccagtaagatatgaagccaaggcgtaataagaccatttaacttgaaaaccggagctactaaacacgtgaaactacacttttagcagtgactactactctttctcctgagtggataggtggccctgaaaagggccgttggttttgcggtagtgtactgtagaggtaagctcagccgccgaagccataaagagtgcgtccctggcgcttgagcgcgtacaccacgtccatggctgtgactgtcttgcgtttggcgtgttccgtgtaggtgacagcatcgcggattacattttccaggaaaactttcagcactccgcgagtttcctcataaatgaggccagaaatacgcttgacgccgccgcggcgagccaggcggcggatagcgggcttggtgattccttggatattgtcacgcaataccttacggtgacgcttggcgccacccttacctagaccctttccgcccttaccgcggccagacatcttgaaaccacagctgttaaatctgtaacgcaatacgtctggcagagccacgcagcacttttataatagcatgacggacctgtttgaaaacctcatgagaaggggcgggaaccacagtcagttcccgcccttctgtgcaa

SEQ ID NO: 125771 - DNA, 36 bp, Homo sapiens
  chr6:26189955-26189991
  Hypo
tacaggcgtgagccaccgcgccgggccataaggtgc

SEQ ID NO: 125772 - DNA, 248 bp, Homo sapiens; identical to SEQ ID NO: 95315
  chr6:26197272-26197520
  Hyper

SEQ ID NO: 125773 - DNA, 25 bp, Homo sapiens
  chr6:26198574-26198599
  Hyper
gttttgagacagtctcgctctgtcg

SEQ ID NO: 125774 - DNA, 85 bp, Homo sapiens; identical to SEQ ID NO: 30346
  chr6:26198839-26198924
  Hyper

SEQ ID NO: 125775 - DNA, 696 bp, Homo sapiens; identical to SEQ ID NO: 95318
  chr6:26199182-26199878
  Hyper

SEQ ID NO: 125776 - DNA, 36 bp, Homo sapiens; identical to SEQ ID NO: 95319
  chr6:26200118-26200154
  Hyper

SEQ ID NO: 125777 - DNA, 613 bp, Homo sapiens; identical to SEQ ID NO: 30350
  chr6:26204685-26205298
  Hyper

SEQ ID NO: 125778 - DNA, 210 bp, Homo sapiens; identical to SEQ ID NO: 30351
  chr6:26205502-26205712
  Hyper

SEQ ID NO: 125779 - DNA, 36 bp, Homo sapiens; identical to SEQ ID NO: 40772
  chr6:26214612-26214648
  Hypo

SEQ ID NO: 125780 - DNA, 223 bp, Homo sapiens; identical to SEQ ID NO: 95323
  chr6:26216047-26216270
  Hyper

SEQ ID NO: 125781 - DNA, 300 bp, Homo sapiens; identical to SEQ ID NO: 95324
  chr6:26216390-26216690
  Hyper

SEQ ID NO: 125782 - DNA, 43 bp, Homo sapiens; identical to SEQ ID NO: 95325
  chr6:26216810-26216853
  Hyper

SEQ ID NO: 125783 - DNA, 80 bp, Homo sapiens; identical to SEQ ID NO: 95326
  chr6:26217076-26217156
  Hyper

SEQ ID NO: 125784 - DNA, 213 bp, Homo sapiens; identical to SEQ ID NO: 95327
  chr6:26217365-26217578
  Hyper

SEQ ID NO: 125785 - DNA, 39 bp, Homo sapiens; identical to SEQ ID NO: 95328
  chr6:26226763-26226802
  Hypo

SEQ ID NO: 125786 - DNA, 1358 bp, Homo sapiens; identical to SEQ ID NO: 95329
  chr6:26233978-26235336
  Hyper

SEQ ID NO: 125787 - DNA, 636 bp, Homo sapiens; identical to SEQ ID NO: 95330
  chr6:26240633-26241269
  Hyper

SEQ ID NO: 125788 - DNA, 41 bp, Homo sapiens; identical to SEQ ID NO: 30359
  chr6:26249960-26250001
  Hyper

SEQ ID NO: 125789 - DNA, 1001 bp, Homo sapiens
  chr6:26250181-26251182
  Hyper
cgggctcccacagtactgggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttgggcatgatagtcactcgcttggcgtggatagcacacaggttggtgtcctcaaagagccccaccaggtaagcctcgcaggcctcctgcagcgccatcacagccgagctctggaagcgcaggtcggtcttgaagtcctgcgcgatctcacgtaccagacgctggaatggtagcttgcgaatcagtagctcagtcgatttctgatagcggcggatttcacggagggcgacagtaccaggcctgtagcggtggggcttcttcacgccaccggtggctggcgcgcttttgcgagccgccttagtggccagctgcttgcgcggggctttgccgccagtggacttacgagctgtttgcttcgtgcgtgccataggaatgggtttcaagcaatggtcacaactgaacaaacagttgttcttactcctatttataaaggcaaagtccttctgattggtccgaatcttccagtttcgcgccctgaattatgtagtgtgataggacttgtgatcagctactaggtctcattttagaaaatcttaacctatctaaatgcttttttcccctagttccttacattttattatgttttatgtgcctacctgtattacgtaccttcattgattttattttaatcagtttgtttgggattatgtttgacagacggaaatgaacgttctgcagttccggagcgattcaaaaataccgcgtttgagagtgatt

SEQ ID NO: 125790 - DNA, 400 bp, Homo sapiens; identical to SEQ ID NO: 30362
  chr6:26251540-26251940
  Hyper

SEQ ID NO: 125791 - DNA, 120 bp, Homo sapiens
  chr6:26252060-26252180
  Hyper
gatcatgaattcctttgtcaacgatatcttcgagcgcatcgccggcgaggcttcccgcctggctcattacaacaagcgttcgaccatcacctccagggagatccagacagccgtgcgcct

SEQ ID NO: 125792 - DNA, 39 bp, Homo sapiens; identical to SEQ ID NO: 30365
  chr6:26252240-26252279
  Hyper

SEQ ID NO: 125793 - DNA, 759 bp, Homo sapiens
  chr6:26271346-26272105
  Hyper
gcggaactctgaaagcgcagatctgtcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggtggacttgcgtgcagtctgcttggtgcgggccatctcagactacctgaaagaaaaactcagccacttggcagagtggaaactgcccttatatatactcagaaacattctaattggccttgttgattttcaaaagacccgcgcaacaaaaccattggctgaagagtccaacgatgtgattggtgaattactggaaaatctgattggatgaatcacttcatttttgaatcctctcttctcggttagtctgcgatccaagaacgttaacttcttaaagttctaattctgcgcttctcaagctgtagtccgtaaacgactactttaagacttggaagacgctaattctcattcagtagatgtgttgtggggccagattcggaggaccacgttttgagaagtttatcttgtgccgttttcttgagtcacctggactgctgctagctggaaacctttgaccattataaggcaggattcctgggtgatgtacctgggaaatcacgagccaagaagtcaccgacatacaacagtg

SEQ ID NO: 125794 - DNA, 422 bp, Homo sapiens; identical to SEQ ID NO: 30369
  chr6:26272431-26272853
  Hyper

SEQ ID NO: 125795 - DNA, 205 bp, Homo sapiens; identical to SEQ ID NO: 95341
  chr6:26273080-26273285
  Hyper

SEQ ID NO: 125796 - DNA, 420 bp, Homo sapiens
  chr6:26273345-26273765
  Hyper
aggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagtaaactagttacctgggtaaaagcgctaacgacccaaaggctcttctaagagccacccatgttgtcatttaaagatctgtaattttccagacttggcattggcaaggtaaaatggctaagcaacacatgggatagtaagggtttactgaaacatccaagttcggccgggcgcagtggctcacgc

SEQ ID NO: 125797 - DNA, 89 bp, Homo sapiens; identical to SEQ ID NO: 95344
  chr6:26283423-26283512
  Hypo

SEQ ID NO: 125798 - DNA, 49 bp, Homo sapiens; identical to SEQ ID NO: 95345
  chr6:26284880-26284929
  Hyper

SEQ ID NO: 125799 - DNA, 30 bp, Homo sapiens; identical to SEQ ID NO: 95346
  chr6:26313515-26313545
  Hyper

SEQ ID NO: 125800 - DNA, 120 bp, Homo sapiens; identical to SEQ ID NO: 30372
  chr6:26322568-26322688
  Hyper

SEQ ID NO: 125801 - DNA, 157 bp, Homo sapiens; identical to SEQ ID NO: 537
  chr6:26327825-26327982
  Hyper

SEQ ID NO: 125802 - DNA, 122 bp, Homo sapiens; identical to SEQ ID NO: 95349
  chr6:26328294-26328416
  Hyper

SEQ ID NO: 125803 - DNA, 108 bp, Homo sapiens; identical to SEQ ID NO: 30375
  chr6:26331703-26331811
  Hyper

SEQ ID NO: 125804 - DNA, 149 bp, Homo sapiens; identical to SEQ ID NO: 95351
  chr6:26332134-26332283
  Hyper

SEQ ID NO: 125805 - DNA, 487 bp, Homo sapiens
  chr6:26501722-26502209
  Hyper
gagcgcggggcactgcgctttggcgggaatctggtcggtgtctgtccgtagttcccatctccacatcccgtctgatcccgctcgtttttcggcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacgactcccctgctgt

SEQ ID NO: 125806 - DNA, 77 bp, Homo sapiens; identical to SEQ ID NO: 95354
  chr6:26534344-26534421
  Hypo

SEQ ID NO: 125807 - DNA, 362 bp, Homo sapiens
  chr6:26550767-26551129
  Hyper
atggcctggaagagccgtactctggatacccgagggcgcggccccagcgccgcgacgccccgcccctctggctgctccgctctgggatgcacttccgacgccctctaggcttgggagttccgcgcctctcggtgtcgcctggggggcgtgctccggttggcgcactgattcccagttgggtaggggaggcttgactgagctcccacccggaatttcaccttagacctttaaagaccttgctccggcctcccgcgccagcgctaacacctagtcctctttagtggagttccggcggaaggggatggcgggcacccgacggtggtctcctcccagatggcgaatttccgcggcttcttcatctt

SEQ ID NO: 125808 - DNA, 91 bp, Homo sapiens; identical to SEQ ID NO: 95357
  chr6:26555188-26555279
  Hyper

SEQ ID NO: 125809 - DNA, 344 bp, Homo sapiens; identical to SEQ ID NO: 95358
  chr6:26577131-26577475
  Hyper

SEQ ID NO: 125810 - DNA, 168 bp, Homo sapiens; identical to SEQ ID NO: 95359
  chr6:26577722-26577890
  Hyper

SEQ ID NO: 125811 - DNA, 41 bp, Homo sapiens; identical to SEQ ID NO: 95361
  chr6:26988028-26988069
  Hyper

SEQ ID NO: 125812 - DNA, 213 bp, Homo sapiens; identical to SEQ ID NO: 30382
  chr6:27059686-27059899
  Hyper

SEQ ID NO: 125813 - DNA, 688 bp, Homo sapiens
  chr6:27064628-27065316
  Hyper
cgactccggtgtgaacggttttgggaacctcggtctcctgctggctcccaggtgcgctatccgacgcagcgagacgcggtgagcctacagaagggctgaccaggctcacctgacgccccaggtcgacagcaaaccccgtgcgccccgttggcccggtcacgcccgcagcctgctcaggcgcctcctgcctcgggaccaggaagcggaagaaagggagagaccggcccggcaattacgtttctatcatgtcttgaacatttgtgtgagtcccacgaaagctaagcccgtttattccccctcgaagcgtttccactcagttcttgatcattcatgtgaaaacgagccatctccacgtctcccaaacgtcttcaaaccgtttcctaagtcttgtaaggccgcctgtgggttcctattacaaactctgaaataaaatactcgggaaacgtgggttatcaagacgaggtggccgagtggttaaggcgatggactgctaatccattgtgctctgcacgcgtgggttcgaatcccaccctcgtcgggggaggtcttttaatacgaagaggaggaaacaacacccaagtccagccaacttccctttcaactctcctggaattcaggtccctggcgttggagaggaaaaaggagctcttgtaattttgtatcatcagtataacgatggtgttgctgg

SEQ ID NO: 125814 - DNA, 299 bp, Homo sapiens
  chr6:27094912-27095211
  Hyper
ctacattagcctatccgttattgccataagatggcgacagcccttctcaactcataaaactaaacaaagttttagctacattatcccatccattatcgccacaagatggcgatagcgcttctcaactcgcctgcgggacggaggcagggtgcggcccggagaactcctccctgttccaacagcagctctccagcccgcagcgcttcctgacgttccgttagttcagtctcctgaacttctctgcatgtagattcctctcagggtagccctttgttgaccaaaaacgaaatatgttcact

SEQ ID NO: 125815 - DNA, 110 bp, Homo sapiens; identical to SEQ ID NO: 95369
  chr6:27099764-27099874
  Hyper

SEQ ID NO: 125816 - DNA, 98 bp, Homo sapiens; identical to SEQ ID NO: 95370
  chr6:27100291-27100389
  Hyper

SEQ ID NO: 125817 - DNA, 600 bp, Homo sapiens; identical to SEQ ID NO: 95371
  chr6:27100449-27101049
  Hyper

SEQ ID NO: 125818 - DNA, 97 bp, Homo sapiens; identical to SEQ ID NO: 95372
  chr6:27101109-27101206
  Hyper

SEQ ID NO: 125819 - DNA, 24 bp, Homo sapiens
  chr6:27102706-27102730
  Hypo
ttaagaagacgttaactcattttt

SEQ ID NO: 125820 - DNA, 498 bp, Homo sapiens
  chr6:27173366-27173864
  Hyper
ttcttgttacctgcccgaggtccttgtcagttcttaaggacaggtgctttgcattatcctccagcactctcccacccactgcaacattcccctctcaccatgcaggtggtaagtaaattttggttgaaaatatttatccagcaagagatgaattgcccggctaatgtcactgccggacgcccgggtagtcgccacttggtttaaaggcggagctgttcttgcatttcaaagaaatccagattccgaaagtaagtaacaaccatgcccgtggcccggttcctttctcttacactcttccaaggaccccttttagacctagaggaaaccccgcagaagtgacagggagagggggaaagctcttttacagtggcgaaaccacgtggctgcgagagcttctcagggagagctcctgttttcaaagtctggcaaatttatcagtttgatttttcttaaacatttatatttttatggagtagaaaatctaccaaacgagtaaag

SEQ ID NO: 125821 - DNA, 257 bp, Homo sapiens; identical to SEQ ID NO: 95376
  chr6:27173924-27174181
  Hyper

SEQ ID NO: 125822 - DNA, 145 bp, Homo sapiens; identical to SEQ ID NO: 95377
  chr6:27182855-27183000
  Hyper

SEQ ID NO: 125823 - DNA, 86 bp, Homo sapiens; identical to SEQ ID NO: 95378
  chr6:27203207-27203293
  Hyper

SEQ ID NO: 125824 - DNA, 27 bp, Homo sapiens
  chr6:27205332-27205359
  Hyper
gaaggtgagaaccctcgtggcccgtac

SEQ ID NO: 125825 - DNA, 867 bp, Homo sapiens
  chr6:27205419-27206286
  Hyper
ggccacccggaaaacagttgttctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctccagcagaaaggaacttcgcctctcccgtgggaaatgagattttctcaaactcacctattccgcccggagaaaatactacagagaaccattcacgagaggggcttccttccttttgaccttgggaggggtccagagacccgggggacgatctgggagcagaagctggtcgttctgagttttccatccaaatggtttgcttatgaaattgactcaccacgcggaatggctggtggatttggatcgcggcatgaggaatccgctccataatggaaggaagaaaatctccggcagctatgcctcgcgggttcataaggactggagagttactccttctctctggccccctcaaaacgcccggtggtatgtctgttgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtcatcaggagtctcaacgtcttccccccaaa

SEQ ID NO: 125826 - DNA, 58 bp, Homo sapiens
  chr6:27206493-27206551
  Hyper
gtccgggcgcggctacggttcctggtacacattcgctgcgcctcgggcagcctaaggg

SEQ ID NO: 125827 - DNA, 61 bp, Homo sapiens; identical to SEQ ID NO: 95384
  chr6:27219595-27219656
  Hyper

SEQ ID NO: 125828 - DNA, 287 bp, Homo sapiens
  chr6:27228172-27228459
  Hyper
gaagagcccacctgccgggcgagcgtctccaagagtgaaaaggaatccgcaccccgcgcgagggagccgggtcctgtgaactctgcggtggcttcgtggttgcttccctgatccattcgctgcagtctcagagttggagcagcttggcgtttactcccgggcctttcccggatgggagaaggaacctgcgcgggaacttgaattttttcgagtcagaatcagcaagttgttgttgtttgagaccaagtgagccaccgcacccagccaagaatcggctgtttaagaaa

SEQ ID NO: 125829 - DNA, 280 bp, Homo sapiens; identical to SEQ ID NO: 95387
  chr6:27228667-27228947
  Hyper

SEQ ID NO: 125830 - DNA, 245 bp, Homo sapiens; identical to SEQ ID NO: 95388
  chr6:27242878-27243123
  Hyper

SEQ ID NO: 125831 - DNA, 522 bp, Homo sapiens; identical to SEQ ID NO: 95389
  chr6:27247546-27248068
  Hyper

SEQ ID NO: 125832 - DNA, 24 bp, Homo sapiens
  chr6:27249182-27249206
  Hyper
gattgcaggcgtgagcaacggcgc

SEQ ID NO: 125833 - DNA, 510 bp, Homo sapiens; identical to SEQ ID NO: 95391
  chr6:27255937-27256447
  Hyper

SEQ ID NO: 125834 - DNA, 329 bp, Homo sapiens; identical to SEQ ID NO: 95392
  chr6:27258095-27258424
  Hyper

SEQ ID NO: 125835 - DNA, 30 bp, Homo sapiens; identical to SEQ ID NO: 95393
  chr6:27264021-27264051
  Hyper

SEQ ID NO: 125836 - DNA, 30 bp, Homo sapiens; identical to SEQ ID NO: 95394
  chr6:27264418-27264448
  Hyper

SEQ ID NO: 125837 - DNA, 1007 bp, Homo sapiens; identical to SEQ ID NO: 95395
  chr6:27279779-27280786
  Hyper

SEQ ID NO: 125838 - DNA, 166 bp, Homo sapiens; identical to SEQ ID NO: 95396
  chr6:27301031-27301197
  Hyper

SEQ ID NO: 125839 - DNA, 578 bp, Homo sapiens; identical to SEQ ID NO: 95397
  chr6:27342451-27343029
  Hyper

SEQ ID NO: 125840 - DNA, 30 bp, Homo sapiens; identical to SEQ ID NO: 95398
  chr6:27356433-27356463
  Hyper

SEQ ID NO: 125841 - DNA, 395 bp, Homo sapiens; identical to SEQ ID NO: 95399
  chr6:27356685-27357080
  Hyper

SEQ ID NO: 125842 - DNA, 21 bp, Homo sapiens
  chr6:27441925-27441946
  Hypo
ccactgcgcccggccccaaca

SEQ ID NO: 125843 - DNA, 658 bp, Homo sapiens; identical to SEQ ID NO: 95402
  chr6:27463029-27463687
  Hyper

SEQ ID NO: 125844 - DNA, 240 bp, Homo sapiens; identical to SEQ ID NO: 95403
  chr6:27471362-27471602
  Hyper

SEQ ID NO: 125845 - DNA, 30 bp, Homo sapiens; identical to SEQ ID NO: 95404
  chr6:27494670-27494700
  Hypo

SEQ ID NO: 125846 - DNA, 1314 bp, Homo sapiens
  chr6:27512392-27513706
  Hyper
tcaaaggttacaaaccgtttctaacctaaattgaagatatagcaaatgccccagtaataagaccaaataatatttgcaagagtccaacgaagggaacacatttcttactattttagagggaaaaacaaatgtgggcgcgctttcactatcagagacattgccggcctcggtcatggaggtcactttccctttgtatctgcggggccgactcacttccattcccagaattccgagactttccccctaacttttgtctaaaaaggaatctgattcaagtctaccccttatttttccactctgacaatactgtagtatctgaagcaagaatcaaccttattaatttagctagatttatcctgacatttacttgtttccatctttttgcgtttttctgtgctggactctccctaagatatttggaaacctgtgttctgagttcttccttttccccgggctcgggtggctgaaggccttggctcttgggaatggtctcgcgtccttcaccagaactgacgggaattatatttacctgaagagtcagagacctcttcagagtcatcttttccagttaggacagaaacaagctccctcctcagctagcacgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccatgggtattcagaggcttgaggttgcttggactctcaattcaatactccctttctgcgggttcgtgagaattaggtgtgaacgtggtgtccgcggatttcagcagctagcgggcaagctccagcgcccagaaactttgagtcgcttgtctaggagtcctgtgttgaattgcaacactatgcactatgttctggttattgatgtgctctgaatgagctctttcgttcgtgagcagaggccctgacgagactgaagaccaactatttccgagcgctccactcaaccattataagttcaccccagccgtcagcgatggcgtaggtaggtagtcgtggccgagtggttaaggcgatggacttgaaatccattggggtttccccgcgcaggttcgaatcctgccgactacggttttaccaggtgcagttcccgcctttcctcaaaacttacccaaattcttgtactccatttgctgctctcctacacaatcctcccactgcatattcagataatatcctctttactcagtgaatggagactaccttatgttgccgttacttcaaaact

SEQ ID NO: 125847 - DNA, 34 bp, Homo sapiens; identical to SEQ ID NO: 95407
  chr6:27526047-27526081
  Hyper

SEQ ID NO: 125848 - DNA, 30 bp, Homo sapiens; identical to SEQ ID NO: 95408
  chr6:27526284-27526314
  Hyper

SEQ ID NO: 125849 - DNA, 604 bp, Homo sapiens; identical to SEQ ID NO: 95409
  chr6:27533773-27534377
  Hyper

SEQ ID NO: 125850 - DNA, 58 bp, Homo sapiens; identical to SEQ ID NO: 95410
  chr6:27551225-27551283
  Hyper

SEQ ID NO: 125851 - DNA, 138 bp, Homo sapiens; identical to SEQ ID NO: 95411
  chr6:27559855-27559993
  Hyper

SEQ ID NO: 125852 - DNA, 34 bp, Homo sapiens; identical to SEQ ID NO: 95412
  chr6:27560276-27560310
  Hyper

SEQ ID NO: 125853 - DNA, 175 bp, Homo sapiens; identical to SEQ ID NO: 95413
  chr6:27560710-27560885
  Hyper

SEQ ID NO: 125854 - DNA, 789 bp, Homo sapiens; identical to SEQ ID NO: 95414
  chr6:27572826-27573615
  Hyper

SEQ ID NO: 125855 - DNA, 379 bp, Homo sapiens; identical to SEQ ID NO: 95415
  chr6:27585093-27585472
  Hyper

SEQ ID NO: 125856 - DNA, 669 bp, Homo sapiens; identical to SEQ ID NO: 95416
  chr6:27598672-27599341
  Hyper

SEQ ID NO: 125857 - DNA, 25 bp, Homo sapiens
  chr6:27631920-27631945
  Hypo
aaaactcaatacttccggccaggcg

SEQ ID NO: 125858 - DNA, 30 bp, Homo sapiens; identical to SEQ ID NO: 95418
  chr6:27633696-27633726
  Hypo

SEQ ID NO: 125859 - DNA, 258 bp, Homo sapiens; identical to SEQ ID NO: 95419
  chr6:27635245-27635503
  Hyper

SEQ ID NO: 125860 - DNA, 211 bp, Homo sapiens; identical to SEQ ID NO: 30418
  chr6:27635858-27636069
  Hyper

SEQ ID NO: 125861 - DNA, 196 bp, Homo sapiens; identical to SEQ ID NO: 95421
  chr6:27636335-27636531
  Hyper

SEQ ID NO: 125862 - DNA, 262 bp, Homo sapiens; identical to SEQ ID NO: 95422
  chr6:27640050-27640312
  Hyper

SEQ ID NO: 125863 - DNA, 734 bp, Homo sapiens
  chr6:27647513-27648247
  Hyper
gggggtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagttcgcgatttttaccaaaataggccacgaaacacacaaagtcgctaaactttttaaccctttcctctttttctttcttatttccgagaaatctcgcaaacggcgtgaacactacgctgattccagaaatggtcgggttcccttccttcactcaggatggtcgcctgctgggagctcatttcgaaccgagctgaacgctcattgctgagtcctgggagaaggtcgcgtttgtacagaaggctcctggcagcgagcaaggccgggagtgggcccagtgcgcacgaagtcgcgccccgaattcccactgggaggaacgcactggaattgaaatgtctgagatcaagccccgctgagaatcaagtcccagaggatcttctcggctggtggaaacgtggaggggaaaggcggtcacgaaaattgaagtctcctagtccaatacagattatccaggccgttgacggcaggaatatatttttatttattcctttacccttctctcctcacagctcttccttctcgtccacgcttgatgggtttt

SEQ ID NO: 125864 - DNA, 258 bp, Homo sapiens; identical to SEQ ID NO: 95425
  chr6:27648814-27649072
  Hyper

SEQ ID NO: 125865 - DNA, 441 bp, Homo sapiens; identical to SEQ ID NO: 95426
  chr6:27661684-27662125
  Hyper

SEQ ID NO: 125866 - DNA, 34 bp, Homo sapiens; identical to SEQ ID NO: 95427
  chr6:27719759-27719793
  Hypo

SEQ ID NO: 125867 - DNA, 153 bp, Homo sapiens; identical to SEQ ID NO: 95428
  chr6:27719853-27720006
  Hypo

SEQ ID NO: 125868 - DNA, 32 bp, Homo sapiens; identical to SEQ ID NO: 95429
  chr6:27755529-27755561
  Hypo

SEQ ID NO: 125869 - DNA, 51 bp, Homo sapiens; identical to SEQ ID NO: 95430
  chr6:27759373-27759424
  Hyper

SEQ ID NO: 125870 - DNA, 620 bp, Homo sapiens; identical to SEQ ID NO: 95431
  chr6:27774739-27775359
  Hyper

SEQ ID NO: 125871 - DNA, 307 bp, Homo sapiens; identical to SEQ ID NO: 95432
  chr6:27775704-27776011
  Hyper

SEQ ID NO: 125872 - DNA, 441 bp, Homo sapiens; identical to SEQ ID NO: 30426
  chr6:27777715-27778156
  Hyper

SEQ ID NO: 125873 - DNA, 221 bp, Homo sapiens; identical to SEQ ID NO: 95434
  chr6:27782421-27782642
  Hyper

SEQ ID NO: 125874 - DNA, 428 bp, Homo sapiens; identical to SEQ ID NO: 95435
  chr6:27832864-27833292
  Hyper

SEQ ID NO: 125875 - DNA, 19 bp, Homo sapiens
  chr6:27833815-27833834
  Hyper
aggctcagtggctcacgcc

SEQ ID NO: 125876 - DNA, 1398 bp, Homo sapiens
  chr6:27834074-27835472
  Hyper
aggaaaaaaaaataatccagtacagaatgacacggtcatatcaaattggcatgtaatagagaccccatcttgaaacttgctactatattgtcttgtgcgttgatagcatattatattaatgccgaacacattagtgacgccgaagtagctggtgcctaaatggcttaaacgcggaaaaaccacatacagatgatggaacaaaaactggccaatcagattatagagcgggctttttaaaatataagaagcttctttgtagctaggcgtctgacaaaaagcttgacaccaacttaacaaaaaccaacggctggaattcatactctaataacagactgcatgggtaaactacgtggggagtccaaccaacaccctggactcttgcttgccttgcgttactcgattagggttgagggagaactgcccgagatttttcgaatgcaaggaatcttgctgcctgatctaacatgttgtgcacagccattttttagaggtctctgggtggctctgaaaagagcctttggggctttgttgcggttttcacacgccagcttcctacttctttttggcagccgccttcttggcctttgcagctttaggttttgctgctttgggcttagcggctttgggctttgccgccttcggcttaactgccttgggcttggcaggactcttggttgcctttttcggtttggcagcggccttggccttcttagggctcttcgccacctttttgacgccagccgccgcgggcttcttcgccttcttcggagtcttcttcactgcctttttcgcccctgcagccttcttggccttcttaggcgtggcccccgcgggcttcttagctttagcggcgcctgccttcttggctttgggcttggcttccccggaggccgccttcttgttgagtttaaaggagccagaagcaccagtgcccttggtctgcaccagggtgcccttgctcaccaagctcttgaggcccagcttaatgcggctgttattcttctccacgtcgtagccaccggccgctaaggccttcttaagggctgccaaagaaaggccattgcgctccttagaagcagccacagccttggtgatcagctctgagactgggggccccgtcgctttgcgcttagcagcgccggcgccggcagccttcttagttgccttcttcttagccggggatttctccaccggcgctggggtggctgtctcggcaggagcggtttccgacatggtggcaagaaactgctagaagagaataagctcgaaatctaaagagcaggttttgcgttgctgctatgctcgggccccgggcttatataagccggcgctgccctgtgattggtggagcgtccaatccaccgccctctggccgccgccgctcgcggttggactccc

SEQ ID NO: 125877 - DNA, 890 bp, Homo sapiens; identical to SEQ ID NO: 30433
  chr6:27839683-27840573
  Hyper

SEQ ID NO: 125878 - DNA, 153 bp, Homo sapiens; identical to SEQ ID NO: 95441
  chr6:27841104-27841257
  Hyper

SEQ ID NO: 125879 - DNA, 461 bp, Homo sapiens; identical to SEQ ID NO: 95442
  chr6:27858279-27858740
  Hyper

SEQ ID NO: 125880 - DNA, 127 bp, Homo sapiens; identical to SEQ ID NO: 95443
  chr6:27934883-27935010
  Hypo

SEQ ID NO: 125881 - DNA, 254 bp, Homo sapiens; identical to SEQ ID NO: 95444
  chr6:28129376-28129630
  Hyper

SEQ ID NO: 125882 - DNA, 40 bp, Homo sapiens; identical to SEQ ID NO: 95445
  chr6:28149166-28149206
  Hypo

SEQ ID NO: 125883 - DNA, 1150 bp, Homo sapiens; identical to SEQ ID NO: 95446
  chr6:28175189-28176339
  Hyper

SEQ ID NO: 125884 - DNA, 170 bp, Homo sapiens; identical to SEQ ID NO: 30438
  chr6:28249409-28249579
  Hyper

SEQ ID NO: 125885 - DNA, 38 bp, Homo sapiens; identical to SEQ ID NO: 30439
  chr6:28303451-28303489
  Hyper

SEQ ID NO: 125886 - DNA, 370 bp, Homo sapiens; identical to SEQ ID NO: 95449
  chr6:28303931-28304301
  Hyper

SEQ ID NO: 125887 - DNA, 824 bp, Homo sapiens
  chr6:28367054-28367878
  Hyper
gcttccctctaacctcgtggtctgtgattataatctgaagtgaggaaggcccaggaaagggtccctaggacgccggcgagcgtctgtgacccaccactgtccagaaatgtcggtaagcgctgaacccaaggatacacagcccgaagcaaacgcggaaggtatgggccttacagcctggaattgctgcagagactgggagccaaaccctcatcctaatgtcccaacgcactttggggagggagagcttcccgcggatccgcctgggtttgggaggaccggggtccactctgcaccggccagggcctgaggggcccagcagctggaatacagcaatctcccgcccacctgctcgcagcgtacagagcacaacatcgctcacctgcggcccccagggccagaagagaactccctcctacggagcgaaggcaagaggcctcgaacccttttgggacccggaacccatcaaaagtgacccacaaaggccggaagcggccacggggggtctaagaaccagcccgcgcggggcgcacttccgcggccgctctaggaagggagcgaaaggggctttcaactcggtagtgtttccgcgcgtctacgtgagaggaaggttgatggctttcaggcccgctggtaaatggaacgggtttatcttctcctcttctttacccagccattgtccacacttcccccgacccgatgggtggtcgaggcttgtagaactgatcttaagacagggaaatcccttgcgtctccattcactttgggattctgtgtctctgaggttagagatgcctcaaagggatgttctccgggggaccttccca

SEQ ID NO: 125888 - DNA, 30 bp, Homo sapiens; identical to SEQ ID NO: 40776
  chr6:28395568-28395598
  Hypo

SEQ ID NO: 125889 - DNA, 604 bp, Homo sapiens
  chr6:28410889-28411493
  Hyper
cctaagatgcagatacggagagttcagagtgccatcagtacagggcagagaggttgaagagctcaggaacagacatagggtgggggaaaggggtaggggcaacgacgctgacttttggttaacaaagcccttccaggctgcggagcaacctcctctgcccttcacctgcccggcccatctctggccaagaagaccctgccgccaaatccccacacccagtccaggtcgcagtgcacagactggcccttccgaagcccctcagcggtagcccgactccgaagctcaccgaggcatccgtgagaggagatgccacctagcgcagatcacatctgctctgaatccttgacaaccgcagcccaaagaatgataaactacaaaggccggaaatgcgtcaccgcggcccgctctccgcgaaacagcggttccggctgtgttccttctaggaaggccggaggtttccacacctctgtggtcgtcactctgaatcccgtctgtagtcttaagtgagatactaggtgacacattgtcttccacgcggcaatataataacggccaacatagtgttttaacacgtattaattcattaccccgcataacaaccctg

SEQ ID NO: 125890 - DNA, 126 bp, Homo sapiens; identical to SEQ ID NO: 95458
  chr6:28414613-28414739
  Hyper

SEQ ID NO: 125891 - DNA, 267 bp, Homo sapiens
  chr6:28414942-28415209
  Hyper
atccagcattgcagccgccgcggcggtctaagagctcaaaccctttcaggcgcgcgcaggaggaggagcggcgggggcggcggaacaagacgaccctcacttaacgtggccgctgtcgccgtgggcatgctgggggcgtcctacgctgccgttcccctttatcggctctattgccagactactggacttggaggatcagcagtttcaggtcatgcctcagaccagattgaaaacatggtgcctgttaaggatcgaatcattaaaatt

SEQ ID NO: 125892 - DNA, 53 bp, Homo sapiens; identical to SEQ ID NO: 95461
  chr6:28457292-28457345
  Hyper

SEQ ID NO: 125893 - DNA, 639 bp, Homo sapiens; identical to SEQ ID NO: 95462
  chr6:28457553-28458192
  Hyper

SEQ ID NO: 125894 - DNA, 186 bp, Homo sapiens; identical to SEQ ID NO: 95479
  chr6:32632511-32632697
  Hyper

SEQ ID NO: 125895 - DNA, 30 bp, Homo sapiens; identical to SEQ ID NO: 95486
  chr6:33579234-33579264
  Hypo

SEQ ID NO: 125896 - DNA, 30 bp, Homo sapiens; identical to SEQ ID NO: 95487
  chr6:33609197-33609227
  Hypo

SEQ ID NO: 125897 - DNA, 30 bp, Homo sapiens; identical to SEQ ID NO: 95490
  chr6:33678306-33678336
  Hypo

SEQ ID NO: 125898 - DNA, 30 bp, Homo sapiens; identical to SEQ ID NO: 95491
  chr6:33678538-33678568
  Hypo

SEQ ID NO: 125899 - DNA, 30 bp, Homo sapiens; identical to SEQ ID NO: 95492
  chr6:33684793-33684823
  Hypo

SEQ ID NO: 125900 - DNA, 30 bp, Homo sapiens; identical to SEQ ID NO: 95493
  chr6:33748632-33748662
  Hypo

SEQ ID NO: 125901 - DNA, 30 bp, Homo sapiens; identical to SEQ ID NO: 95494
  chr6:33761619-33761649
  Hypo

SEQ ID NO: 125902 - DNA, 468 bp, Homo sapiens; identical to SEQ ID NO: 95495
  chr6:33955284-33955752
  Hypo

SEQ ID NO: 125903 - DNA, 195 bp, Homo sapiens; identical to SEQ ID NO: 95496
  chr6:33995948-33996143
  Hypo

SEQ ID NO: 125904 - DNA, 30 bp, Homo sapiens; identical to SEQ ID NO: 95497
  chr6:34021237-34021267
  Hypo

SEQ ID NO: 125905 - DNA, 41 bp, Homo sapiens; identical to SEQ ID NO: 95498
  chr6:34034613-34034654
  Hypo

SEQ ID NO: 125906 - DNA, 44 bp, Homo sapiens; identical to SEQ ID NO: 95499
  chr6:34037899-34037943
  Hypo

SEQ ID NO: 125907 - DNA, 30 bp, Homo sapiens; identical to SEQ ID NO: 95500
  chr6:34038143-34038173
  Hypo

SEQ ID NO: 125908 - DNA, 30 bp, Homo sapiens; identical to SEQ ID NO: 95502
  chr6:34100465-34100495
  Hyper

SEQ ID NO: 125909 - DNA, 136 bp, Homo sapiens; identical to SEQ ID NO: 95503
  chr6:34110456-34110592
  Hyper

SEQ ID NO: 125910 - DNA, 1919 bp, Homo sapiens; identical to SEQ ID NO: 95504
  chr6:34111638-34113557
  Hyper

SEQ ID NO: 125911 - DNA, 174 bp, Homo sapiens; identical to SEQ ID NO: 95505
  chr6:34119143-34119317
  Hyper

SEQ ID NO: 125912 - DNA, 120 bp, Homo sapiens; identical to SEQ ID NO: 5043
  chr6:34170868-34170988
  Hypo

SEQ ID NO: 125913 - DNA, 31 bp, Homo sapiens; identical to SEQ ID NO: 5044
  chr6:34171048-34171079
  Hypo

SEQ ID NO: 125914 - DNA, 46 bp, Homo sapiens; identical to SEQ ID NO: 95509
  chr6:34392006-34392052
  Hypo

SEQ ID NO: 125915 - DNA, 31 bp, Homo sapiens; identical to SEQ ID NO: 95510
  chr6:34396511-34396542
  Hypo

SEQ ID NO: 125916 - DNA, 611 bp, Homo sapiens; identical to SEQ ID NO: 95511
  chr6:34433479-34434090
  Hyper

SEQ ID NO: 125917 - DNA, 30 bp, Homo sapiens; identical to SEQ ID NO: 95512
  chr6:34490562-34490592
  Hypo

SEQ ID NO: 125918 - DNA, 30 bp, Homo sapiens; identical to SEQ ID NO: 95513
  chr6:34498821-34498851
  Hypo

SEQ ID NO: 125919 - DNA, 30 bp, Homo sapiens; identical to SEQ ID NO: 14846
  chr6:34514348-34514378
  Hypo

SEQ ID NO: 125920 - DNA, 30 bp, Homo sapiens; identical to SEQ ID NO: 95515
  chr6:34518840-34518870
  Hypo

SEQ ID NO: 125921 - DNA, 29 bp, Homo sapiens
  chr6:34535577-34535606
  Hypo
gccctgccatcatagcgctgacagcggct

SEQ ID NO: 125922 - DNA, 29 bp, Homo sapiens
  chr6:34535906-34535935
  Hypo
ggcgtgagtcactgcgcccagccatatcc

SEQ ID NO: 125923 - DNA, 70 bp, Homo sapiens; identical to SEQ ID NO: 95518
  chr6:34618507-34618577
  Hypo

SEQ ID NO: 125924 - DNA, 70 bp, Homo sapiens; identical to SEQ ID NO: 40786
  chr6:34671603-34671673
  Hypo

SEQ ID NO: 125925 - DNA, 19 bp, Homo sapiens
  chr6:34723890-34723909
  Hypo
gggcgcggtgggtcacgcc

SEQ ID NO: 125926 - DNA, 19 bp, Homo sapiens
  chr6:34724209-34724228
  Hypo
aagacgagataacctttct

SEQ ID NO: 125927 - DNA, 45 bp, Homo sapiens; identical to SEQ ID NO: 95523
  chr6:34854786-34854831
  Hypo

SEQ ID NO: 125928 - DNA, 50 bp, Homo sapiens; identical to SEQ ID NO: 95525
  chr6:35026986-35027036
  Hypo

SEQ ID NO: 125929 - DNA, 56 bp, Homo sapiens; identical to SEQ ID NO: 95526
  chr6:35109367-35109423
  Hypo

SEQ ID NO: 125930 - DNA, 297 bp, Homo sapiens; identical to SEQ ID NO: 40791
  chr6:35149810-35150107
  Hypo

SEQ ID NO: 125931 - DNA, 191 bp, Homo sapiens; identical to SEQ ID NO: 95528
  chr6:35181252-35181443
  Hyper

SEQ ID NO: 125932 - DNA, 122 bp, Homo sapiens; identical to SEQ ID NO: 95529
  chr6:35181861-35181983
  Hyper

SEQ ID NO: 125933 - DNA, 64 bp, Homo sapiens; identical to SEQ ID NO: 95530
  chr6:35182200-35182264
  Hyper

SEQ ID NO: 125934 - DNA, 266 bp, Homo sapiens; identical to SEQ ID NO: 95531
  chr6:35309463-35309729
  Hypo

SEQ ID NO: 125935 - DNA, 234 bp, Homo sapiens; identical to SEQ ID NO: 95532
  chr6:35359757-35359991
  Hypo

SEQ ID NO: 125936 - DNA, 47 bp, Homo sapiens; identical to SEQ ID NO: 95533
  chr6:35454542-35454589
  Hypo

SEQ ID NO: 125937 - DNA, 65 bp, Homo sapiens; identical to SEQ ID NO: 95534
  chr6:35466126-35466191
  Hyper

SEQ ID NO: 125938 - DNA, 106 bp, Homo sapiens
  chr6:35479546-35479652
  Hyper
ggggaaggctcctcccgcggcctccccgtccgcccagctgagccgagatgcggggttcagacagggtcccatccgcgggtccgcgaggcagcgcctctacccgcta

SEQ ID NO: 125939 - DNA, 30 bp, Homo sapiens; identical to SEQ ID NO: 95536
  chr6:35744172-35744202
  Hyper

SEQ ID NO: 125940 - DNA, 103 bp, Homo sapiens; identical to SEQ ID NO: 95537
  chr6:35773143-35773246
  Hyper

SEQ ID NO: 125941 - DNA, 25 bp, Homo sapiens
  chr6:35895210-35895235
  Hypo
ccacggtgcccggcccccaggtatt

SEQ ID NO: 125942 - DNA, 257 bp, Homo sapiens
  chr6:35992277-35992534
  Hyper
cacctggctccttggcgggggcgggagtgcgggcgctgggatcccacacggctctcgcctggctggcggcgctgcggacgcggataccggcggcggttcccgagccgttgtggcctagcccgcgggcgttccgggcgggctgaggagatgagagtgggggaggggacgaggaagaggagcatgagcagctgggctagggagccaggaaagtggtacctgggtcgccctcctcatacctgagtcgtgggatccccttg

SEQ ID NO: 125943 - DNA, 57 bp, Homo sapiens; identical to SEQ ID NO: 30462
  chr6:36088966-36089023
  Hyper

SEQ ID NO: 125944 - DNA, 104 bp, Homo sapiens; identical to SEQ ID NO: 95542
  chr6:36165588-36165692
  Hypo

SEQ ID NO: 125945 - DNA, 171 bp, Homo sapiens; identical to SEQ ID NO: 95543
  chr6:36214623-36214794
  Hypo

SEQ ID NO: 125946 - DNA, 200 bp, Homo sapiens; identical to SEQ ID NO: 95544
  chr6:36238319-36238519
  Hypo

SEQ ID NO: 125947 - DNA, 29 bp, Homo sapiens
  chr6:36240231-36240260
  Hypo
acaggccacagacccggggccatggcctg

SEQ ID NO: 125948 - DNA, 369 bp, Homo sapiens; identical to SEQ ID NO: 95546
  chr6:36252866-36253235
  Hyper

SEQ ID NO: 125949 - DNA, 164 bp, Homo sapiens; identical to SEQ ID NO: 95547
  chr6:36287117-36287281
  Hypo

SEQ ID NO: 125950 - DNA, 30 bp, Homo sapiens; identical to SEQ ID NO: 95548
  chr6:36313961-36313991
  Hypo

SEQ ID NO: 125951 - DNA, 56 bp, Homo sapiens; identical to SEQ ID NO: 95549
  chr6:36344624-36344680
  Hypo

SEQ ID NO: 125952 - DNA, 30 bp, Homo sapiens; identical to SEQ ID NO: 95550
  chr6:36355327-36355357
  Hyper

SEQ ID NO: 125953 - DNA, 18 bp, Homo sapiens
  chr6:36392123-36392141
  Hypo
aaatgaagattcaggcgg

SEQ ID NO: 125954 - DNA, 91 bp, Homo sapiens; identical to SEQ ID NO: 95552
  chr6:36535507-36535598
  Hypo

SEQ ID NO: 125955 - DNA, 367 bp, Homo sapiens; identical to SEQ ID NO: 95553
  chr6:36806909-36807276
  Hyper

SEQ ID NO: 125956 - DNA, 495 bp, Homo sapiens; identical to SEQ ID NO: 95554
  chr6:36808059-36808554
  Hyper

SEQ ID NO: 125957 - DNA, 30 bp, Homo sapiens; identical to SEQ ID NO: 14852
  chr6:36831576-36831606
  Hypo

SEQ ID NO: 125958 - DNA, 30 bp, Homo sapiens; identical to SEQ ID NO: 40799
  chr6:36881595-36881625
  Hypo

SEQ ID NO: 125959 - DNA, 30 bp, Homo sapiens; identical to SEQ ID NO: 95557
  chr6:36932229-36932259
  Hypo

SEQ ID NO: 125960 - DNA, 56 bp, Homo sapiens; identical to SEQ ID NO: 95558
  chr6:36949243-36949299
  Hypo

SEQ ID NO: 125961 - DNA, 46 bp, Homo sapiens; identical to SEQ ID NO: 40801
  chr6:37004177-37004223
  Hypo

SEQ ID NO: 125962 - DNA, 105 bp, Homo sapiens
  chr6:37012625-37012730
  Hypo
cagatcaaaaatggcggcagttggtgtgttctcggtttctcggctgctgggtcggtcccgcccacagctggggcggcctatgtcgagtggcgcccatggagaaga

SEQ ID NO: 125963 - DNA, 510 bp, Homo sapiens; identical to SEQ ID NO: 95560
  chr6:37024139-37024649
  Hypo

SEQ ID NO: 125964 - DNA, 68 bp, Homo sapiens; identical to SEQ ID NO: 95561
  chr6:37027628-37027696
  Hypo

SEQ ID NO: 125965 - DNA, 79 bp, Homo sapiens; identical to SEQ ID NO: 95562
  chr6:37053276-37053355
  Hypo

SEQ ID NO: 125966 - DNA, 30 bp, Homo sapiens; identical to SEQ ID NO: 95563
  chr6:37139199-37139229
  Hyper

SEQ ID NO: 125967 - DNA, 45 bp, Homo sapiens; identical to SEQ ID NO: 95564
  chr6:37275438-37275483
  Hypo

SEQ ID NO: 125968 - DNA, 30 bp, Homo sapiens; identical to SEQ ID NO: 40805
  chr6:37358523-37358553
  Hypo

SEQ ID NO: 125969 - DNA, 180 bp, Homo sapiens; identical to SEQ ID NO: 40806
  chr6:37391410-37391590
  Hypo

SEQ ID NO: 125970 - DNA, 42 bp, Homo sapiens; identical to SEQ ID NO: 95567
  chr6:37392290-37392332
  Hypo

SEQ ID NO: 125971 - DNA, 137 bp, Homo sapiens; identical to SEQ ID NO: 95569
  chr6:37526552-37526689
  Hypo

SEQ ID NO: 125972 - DNA, 30 bp, Homo sapiens; identical to SEQ ID NO: 40807
  chr6:37557743-37557773
  Hypo

SEQ ID NO: 125973 - DNA, 1256 bp, Homo sapiens
  chr6:37663985-37665241
  Hyper
agggccaggggatgccggcatcctgatcagggtgtcaagccctgagtagaagaagcgaagccgcagcaacagcggggaaggcgagcccgccgcccggccttggtgctgacagccggctcgcccgcaagccgcgcggcaactccggctcatgcatcgcttggcttccactccggaggccgagccaggacgaggtttcggtgcaagtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttgcgcctcttgcaaagtttccgcgcgaggttaagccaaggtggagcgggacgcgggctcttaccgtagactccttgtccccggcagtggaaggggatcagcgccagaagtagaaggcaggtcacctccatcttcacggccggtgcttcatccccgcgaggcggcgcagcccgagaggcggcggggggcgcattcgccggggccccgcgacgcccctatgtccccccctttccctgagaggtgagagagagagcggcgacgaagaccaggagactgaagaggcggaggtggcggcgacccgtgtttctcctccggcggggccgctgcccgcgtggggacgcagggggcgctggcccagccccgggtgcctcggcgcgcccggcacagcagccagcgccccgacccgaggagcccggccgccgagccgccccgggtacccagggccgtccgcgcgggatgctaggcgccggggacctctcggcggcggaggcggcgcttcgatccaacaggccacggacgactgacaaacttgtcgtttccccgcactggggccgcccctcagcggagcggagtcggggaggccggggctccgctcgagttaatcaatctgctgtttccagtcctgcggccgctgccgtgggctcagcggcccgactccagggggccgggctgaaagcactcgcggcggcgaagcagccccgggcccggccctcctgatccggggagcagcgcgggctgggttcggccgagggacgagcgccgcgggtccccgggtccgtgaagtt

SEQ ID NO: 125974 - DNA, 470 bp, Homo sapiens; identical to SEQ ID NO: 95574
  chr6:37673008-37673478
  Hyper

SEQ ID NO: 125975 - DNA, 30 bp, Homo sapiens; identical to SEQ ID NO: 95575
  chr6:37751633-37751663
  Hyper

SEQ ID NO: 125976 - DNA, 30 bp, Homo sapiens; identical to SEQ ID NO: 40808
  chr6:37776410-37776440
  Hypo

SEQ ID NO: 125977 - DNA, 32 bp, Homo sapiens; identical to SEQ ID NO: 95577
  chr6:37776736-37776768
  Hypo

SEQ ID NO: 125978 - DNA, 21 bp, Homo sapiens
  chr6:37791857-37791878
  Hypo
tattaacgtcatatttttagg

SEQ ID NO: 125979 - DNA, 34 bp, Homo sapiens; identical to SEQ ID NO: 40810
  chr6:38018000-38018034
  Hypo

SEQ ID NO: 125980 - DNA, 98 bp, Homo sapiens; identical to SEQ ID NO: 95580
  chr6:38101874-38101972
  Hypo

SEQ ID NO: 125981 - DNA, 30 bp, Homo sapiens; identical to SEQ ID NO: 40811
  chr6:38137726-38137756
  Hypo

SEQ ID NO: 125982 - DNA, 43 bp, Homo sapiens; identical to SEQ ID NO: 95582
  chr6:38183138-38183181
  Hypo

SEQ ID NO: 125983 - DNA, 30 bp, Homo sapiens; identical to SEQ ID NO: 40813
  chr6:38684078-38684108
  Hypo

SEQ ID NO: 125984 - DNA, 30 bp, Homo sapiens; identical to SEQ ID NO: 95586
  chr6:38848809-38848839
  Hypo

SEQ ID NO: 125985 - DNA, 723 bp, Homo sapiens
  chr6:39016211-39016934
  Hyper
gggaccctgaatgggcgggggttgctgtagctttcctcagctgggagacccgggaggaggtccggggtgccagggtgggaggagggcctggcttgtcgctgaaagccggccaggcgcactgtcggcgctcagagctggtggccgcctcctgcgcttcctgattcccagccgcgctcgctcggagagcagtgcccgctatctcctggcccgggaccggcagaggggtgcggcggggcgggcccaggggtctctggcggccggaagaaccgggaccctgccaggcccctcccgcgggcagggcggcccctcgccggctcctcccccaccgcccgccaccagcccgggatcagtctccgcacgcggttccgcaggtggcagcgatggcccagtcctgaactccccgccatggccggcgcccccggcccgctgcgccttgcgctgctgctgctcgggatggtgggcagggccggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttcctcgc

SEQ ID NO: 125986 - DNA, 307 bp, Homo sapiens; identical to SEQ ID NO: 95593
  chr6:39197084-39197391
  Hyper

SEQ ID NO: 125987 - DNA, 911 bp, Homo sapiens; identical to SEQ ID NO: 95596
  chr6:39281088-39281999
  Hyper

SEQ ID NO: 125988 - DNA, 29 bp, Homo sapiens
  chr6:39329863-39329892
  Hyper
gcgtgagagtatgacgttctcaggactcg

SEQ ID NO: 125989 - DNA, 766 bp, Homo sapiens; identical to SEQ ID NO: 95599
  chr6:39759800-39760566
  Hyper

SEQ ID NO: 125990 - DNA, 443 bp, Homo sapiens; identical to SEQ ID NO: 95601
  chr6:39901919-39902362
  Hyper

SEQ ID NO: 125991 - DNA, 43 bp, Homo sapiens; identical to SEQ ID NO: 40814
  chr6:40244038-40244081
  Hypo

SEQ ID NO: 125992 - DNA, 195 bp, Homo sapiens; identical to SEQ ID NO: 95605
  chr6:40317758-40317953
  Hypo

SEQ ID NO: 125993 - DNA, 35 bp, Homo sapiens; identical to SEQ ID NO: 95606
  chr6:40360217-40360252
  Hypo

SEQ ID NO: 125994 - DNA, 340 bp, Homo sapiens; identical to SEQ ID NO: 95607
  chr6:40554520-40554860
  Hyper

SEQ ID NO: 125995 - DNA, 40 bp, Homo sapiens; identical to SEQ ID NO: 95608
  chr6:40555175-40555215
  Hyper

SEQ ID NO: 125996 - DNA, 579 bp, Homo sapiens; identical to SEQ ID NO: 95609
  chr6:40555275-40555854
  Hyper

SEQ ID NO: 125997 - DNA, 30 bp, Homo sapiens; identical to SEQ ID NO: 95610
  chr6:41160377-41160407
  Hypo

SEQ ID NO: 125998 - DNA, 228 bp, Homo sapiens; identical to SEQ ID NO: 95611
  chr6:41337024-41337252
  Hyper

SEQ ID NO: 125999 - DNA, 806 bp, Homo sapiens
  chr6:41339221-41340027
  Hyper
tgcttccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagtcgtgtaacaagtgtgcgattgcgcgtgcgactggtgtgtgcgcgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgcacattccggaggaggcgcgcg

SEQ ID NO: 126000 - DNA, 1585 bp, Homo sapiens
  chr6:41340707-41342292
  Hyper
ggcacattcccagtgcgggcgctcgcagcaccacctcgcctggccgcccccagtcctgacccctttctagcgctggatcggccgggtccggcctccgtgctcgcggggtcgtccgtcggcgctggctagttaagaaaaataaacaacgttccaaatgaaggcgattcctttcaacccaagctccgccgcctgccagagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgccccccaccgggccgggacctccgccagcggtcctcggcgcccttcctgccccctccccccagcggtctcggccccatcccgaaccgccaccctgggatccccagccctcctgcgccctcgaggccaccgggctcctgcgagcaacgcttccctgcggcgaccgcgcgctgggatcactcaacaccaagaaaaaaaaaatgcactgggaacgacagaaacctgccttagcgaactatcctctagtggatcgggcgtggggggctgcttccagataggacccctgctcaccctgcagggtgcggccgggacaactacgggcgccactgcggaaggcctgacctgatccggcacggtgtggccaccgtgggcccacagagggtgaaggggtagcttatgctgagtgggggtgtccacctggacagaccaggcgagcctcgctcctggtgcgggagctagttttccctggatcttccgcggcagagaagcctgcgtccgggaccagcagagtgagccgaccggcggatgcagttgaccccattcgcgtccaaacttcacttcgagaaaacgcagccctgcgcgcagtccacgcaggacgcgacagcgccaccctcgtttgtacggctgcgcgaatgactcgagagagtcgcggtggctgcacgtgcgtgcgcaaagcgggaaggagtcagaaacagtcccgggcgcagagcgaagaaatcctgggacctcggcaagagggcctcaccactggagatggggtagctacgccgtgtggctgggggaggggtggtagggggcgcctagccagttgcaggggcctcgggactttccatggcctcacccctcttctaggacacgtggccagcgtcctccaggccaccactggggatgagggtgctcgagcctcggtgcccagagtgttgggaggagcggcggcgcacccgcttcctccgaattcctgcatcgcaacgctgggccgcaccgaaggcggtaggatgtgccaggcgtaaagctccgattggcttcgagagagtcgggggcaggcgaagacgcggaccacgcgggcttcctgtcctctttattcccagctctttttcgcgggataagcgtgtctgacggcttaagtgcagtctccctgcgtccctgcctgagctttccagctcccaattacttcgcgggattgggagccgagcgctctccctggagc

SEQ ID NO: 126001 - DNA, 923 bp, Homo sapiens; identical to SEQ ID NO: 95616
  chr6:41342779-41343702
  Hyper

SEQ ID NO: 126002 - DNA, 30 bp, Homo sapiens; identical to SEQ ID NO: 95618
  chr6:41395227-41395257
  Hyper

SEQ ID NO: 126003 - DNA, 557 bp, Homo sapiens; identical to SEQ ID NO: 95619
  chr6:41438018-41438575
  Hyper

SEQ ID NO: 126004 - DNA, 235 bp, Homo sapiens; identical to SEQ ID NO: 95620
  chr6:41472913-41473148
  Hyper

SEQ ID NO: 126005 - DNA, 856 bp, Homo sapiens
  chr6:41605766-41606622
  Hyper
actgagaaacttgatcgcgcccatctttggggcaaagagatttggaggccgcaattattcagacagttccacgaagtggttgaggtttctctctttctcctgattttccagaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggcgaggagggggcggggagagggtgggccagggaagaggggaggggagaggcgagtaggggaggagcgaggggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccaggtaggaccgggagtggcgagcgaagctggacaggggcgggtgggcggctgaaggggcca

SEQ ID NO: 126006 - DNA, 153 bp, Homo sapiens; identical to SEQ ID NO: 95624
  chr6:41709830-41709983
  Hypo

SEQ ID NO: 126007 - DNA, 35 bp, Homo sapiens; identical to SEQ ID NO: 40816
  chr6:41715572-41715607
  Hypo

SEQ ID NO: 126008 - DNA, 192 bp, Homo sapiens; identical to SEQ ID NO: 95626
  chr6:41773568-41773760
  Hypo

SEQ ID NO: 126009 - DNA, 37 bp, Homo sapiens; identical to SEQ ID NO: 95627
  chr6:41919768-41919805
  Hypo

SEQ ID NO: 126010 - DNA, 20 bp, Homo sapiens
  chr6:42062066-42062086
  Hypo
gcctgagcaacacagcgaca

SEQ ID NO: 126011 - DNA, 23 bp, Homo sapiens
  chr6:42066001-42066024
  Hypo
agccaccgcgcccagccaaggaa

SEQ ID NO: 126012 - DNA, 20 bp, Homo sapiens
  chr6:42076874-42076894
  Hypo
ttaaatagggcagtccggcc

SEQ ID NO: 126013 - DNA, 155 bp, Homo sapiens; identical to SEQ ID NO: 95631
  chr6:42090718-42090873
  Hypo

SEQ ID NO: 126014 - DNA, 61 bp, Homo sapiens; identical to SEQ ID NO: 95632
  chr6:42110212-42110273
  Hyper

SEQ ID NO: 126015 - DNA, 77 bp, Homo sapiens; identical to SEQ ID NO: 95633
  chr6:42110870-42110947
  Hypo

SEQ ID NO: 126016 - DNA, 90 bp, Homo sapiens; identical to SEQ ID NO: 95634
  chr6:42184556-42184646
  Hypo

SEQ ID NO: 126017 - DNA, 176 bp, Homo sapiens; identical to SEQ ID NO: 40822
  chr6:42190336-42190512
  Hypo

SEQ ID NO: 126018 - DNA, 38 bp, Homo sapiens; identical to SEQ ID NO: 95636
  chr6:42419139-42419177
  Hyper

SEQ ID NO: 126019 - DNA, 41 bp, Homo sapiens; identical to SEQ ID NO: 95637
  chr6:42441227-42441268
  Hypo

SEQ ID NO: 126020 - DNA, 30 bp, Homo sapiens; identical to SEQ ID NO: 95638
  chr6:42626581-42626611
  Hypo

SEQ ID NO: 126021 - DNA, 30 bp, Homo sapiens; identical to SEQ ID NO: 95639
  chr6:42762875-42762905
  Hypo

SEQ ID NO: 126022 - DNA, 43 bp, Homo sapiens; identical to SEQ ID NO: 95641
  chr6:42773440-42773483
  Hypo

SEQ ID NO: 126023 - DNA, 43 bp, Homo sapiens; identical to SEQ ID NO: 95642
  chr6:42773723-42773766
  Hypo

SEQ ID NO: 126024 - DNA, 224 bp, Homo sapiens; identical to SEQ ID NO: 40824
  chr6:42813314-42813538
  Hypo

SEQ ID NO: 126025 - DNA, 37 bp, Homo sapiens; identical to SEQ ID NO: 40825
  chr6:42846392-42846429
  Hypo

SEQ ID NO: 126026 - DNA, 96 bp, Homo sapiens; identical to SEQ ID NO: 40826
  chr6:42846609-42846705
  Hypo

SEQ ID NO: 126027 - DNA, 28 bp, Homo sapiens
  chr6:42868404-42868432
  Hypo
gagccaccgtgcccggccagcttgattt

SEQ ID NO: 126028 - DNA, 367 bp, Homo sapiens
  chr6:42879393-42879760
  Hyper
gggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcccgggggggaacccaccgcgacggcgcgcacctgggcgcgggctgtgcctgggaacgcgcggggaccgcggcctccaggcagccctgggaaagcaagggccgggagcgcagccctggaggcagagtgttccctcaggaccgtcaggagagcgccatccacaggattattaaaatagccatccagacggaaatcgagtgaggctggca

SEQ ID NO: 126029 - DNA, 38 bp, Homo sapiens; identical to SEQ ID NO: 95649
  chr6:42928321-42928359
  Hyper

SEQ ID NO: 126030 - DNA, 26 bp, Homo sapiens
  chr6:42951450-42951476
  Hypo
gggattacaggcgtgagacaccgtgc

SEQ ID NO: 126031 - DNA, 37 bp, Homo sapiens; identical to SEQ ID NO: 95651
  chr6:43119834-43119871
  Hypo

SEQ ID NO: 126032 - DNA, 30 bp, Homo sapiens; identical to SEQ ID NO: 95652
  chr6:43149410-43149440
  Hypo

SEQ ID NO: 126033 - DNA, 38 bp, Homo sapiens; identical to SEQ ID NO: 95653
  chr6:43193505-43193543
  Hypo

SEQ ID NO: 126034 - DNA, 370 bp, Homo sapiens
  chr6:43211197-43211567
  Hyper
ctgatgctggcggcgcggtgcattgtgggcagctccccgctctgccgctgccgccgccgtcgcccaaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcggggcgggccggggtcggggcgggggctccttcgtgggctcagggggctccgcctggctcgcctcccagcgcagccttcttgggctcccctccgcgctgctgtcgccgc

SEQ ID NO: 126035 - DNA, 106 bp, Homo sapiens; identical to SEQ ID NO: 95656
  chr6:43215365-43215471
  Hyper

SEQ ID NO: 126036 - DNA, 438 bp, Homo sapiens; identical to SEQ ID NO: 30494
  chr6:43237245-43237683
  Hyper

SEQ ID NO: 126037 - DNA, 164 bp, Homo sapiens; identical to SEQ ID NO: 95658
  chr6:43242769-43242933
  Hyper

SEQ ID NO: 126038 - DNA, 42 bp, Homo sapiens; identical to SEQ ID NO: 30496
  chr6:43243433-43243475
  Hyper

SEQ ID NO: 126039 - DNA, 190 bp, Homo sapiens
  chr6:43244084-43244274
  Hyper
tagtgtacatagcggcgtcggggggtggccccaggcccgggtagaaaagcatgcactgagccccctgcccctagactgcgagtactgtacaaatccaacacttgaaaccgacacgcacacgcgcggcgccgccacgggggtgggacacggacacgcacccacgcgcacacggccgcgcacgggcggggag

SEQ ID NO: 126040 - DNA, 217 bp, Homo sapiens; identical to SEQ ID NO: 95661
  chr6:43251405-43251622
  Hypo

SEQ ID NO: 126041 - DNA, 92 bp, Homo sapiens; identical to SEQ ID NO: 95662
  chr6:43276520-43276612
  Hyper

SEQ ID NO: 126042 - DNA, 67 bp, Homo sapiens; identical to SEQ ID NO: 95665
  chr6:43423602-43423669
  Hyper

SEQ ID NO: 126043 - DNA, 206 bp, Homo sapiens; identical to SEQ ID NO: 95666
  chr6:43424414-43424620
  Hypo

SEQ ID NO: 126044 - DNA, 103 bp, Homo sapiens; identical to SEQ ID NO: 95667
  chr6:43425406-43425509
  Hypo

SEQ ID NO: 126045 - DNA, 71 bp, Homo sapiens; identical to SEQ ID NO: 95668
  chr6:43476085-43476156
  Hypo

SEQ ID NO: 126046 - DNA, 209 bp, Homo sapiens; identical to SEQ ID NO: 95669
  chr6:43478536-43478745
  Hypo

SEQ ID NO: 126047 - DNA, 30 bp, Homo sapiens; identical to SEQ ID NO: 14862
  chr6:43486338-43486368
  Hypo

SEQ ID NO: 126048 - DNA, 539 bp, Homo sapiens
  chr6:43612825-43613364
  Hyper
cgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctataggtgaggaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacggtcaagaggtggttgagggaaagggcggggatggggatgtctcggaatctgaggctagggcggagcctgagagggcggggcaatggacgggcgatgtcccccggagggcggggccttgcgagagcttgttctc

SEQ ID NO: 126049 - DNA, 149 bp, Homo sapiens; identical to SEQ ID NO: 95673
  chr6:43639599-43639748
  Hypo

SEQ ID NO: 126050 - DNA, 30 bp, Homo sapiens; identical to SEQ ID NO: 95674
  chr6:43706822-43706852
  Hypo

SEQ ID NO: 126051 - DNA, 72 bp, Homo sapiens; identical to SEQ ID NO: 40831
  chr6:43748463-43748535
  Hypo

SEQ ID NO: 126052 - DNA, 30 bp, Homo sapiens; identical to SEQ ID NO: 95676
  chr6:43749564-43749594
  Hypo

SEQ ID NO: 126053 - DNA, 30 bp, Homo sapiens; identical to SEQ ID NO: 95677
  chr6:43750186-43750216
  Hypo

SEQ ID NO: 126054 - DNA, 37 bp, Homo sapiens; identical to SEQ ID NO: 95678
  chr6:43893966-43894003
  Hypo

SEQ ID NO: 126055 - DNA, 55 bp, Homo sapiens
  chr6:43970452-43970507
  Hyper
gtgcagacgctggcccggatgtcgcggaggactcgcgggccggtagagcgcgcgg

SEQ ID NO: 126056 - DNA, 73 bp, Homo sapiens; identical to SEQ ID NO: 95680
  chr6:44044377-44044450
  Hyper

SEQ ID NO: 126057 - DNA, 100 bp, Homo sapiens; identical to SEQ ID NO: 95681
  chr6:44241060-44241160
  Hypo

SEQ ID NO: 126058 - DNA, 30 bp, Homo sapiens; identical to SEQ ID NO: 95682
  chr6:44250199-44250229
  Hypo

SEQ ID NO: 126059 - DNA, 350 bp, Homo sapiens; identical to SEQ ID NO: 95683
  chr6:44264917-44265267
  Hyper

SEQ ID NO: 126060 - DNA, 279 bp, Homo sapiens; identical to SEQ ID NO: 95684
  chr6:44265528-44265807
  Hyper

SEQ ID NO: 126061 - DNA, 41 bp, Homo sapiens; identical to SEQ ID NO: 14865
  chr6:44437145-44437186
  Hypo

SEQ ID NO: 126062 - DNA, 53 bp, Homo sapiens; identical to SEQ ID NO: 95686
  chr6:44443969-44444022
  Hypo

SEQ ID NO: 126063 - DNA, 51 bp, Homo sapiens; identical to SEQ ID NO: 95687
  chr6:44695868-44695919
  Hypo

SEQ ID NO: 126064 - DNA, 30 bp, Homo sapiens; identical to SEQ ID NO: 95689
  chr6:45346268-45346298
  Hyper

SEQ ID NO: 126065 - DNA, 520 bp, Homo sapiens; identical to SEQ ID NO: 95690
  chr6:45387578-45388098
  Hyper

SEQ ID NO: 126066 - DNA, 38 bp, Homo sapiens; identical to SEQ ID NO: 30505
  chr6:45388359-45388397
  Hyper

SEQ ID NO: 126067 - DNA, 55 bp, Homo sapiens; identical to SEQ ID NO: 95692
  chr6:45388792-45388847
  Hyper

SEQ ID NO: 126068 - DNA, 683 bp, Homo sapiens; identical to SEQ ID NO: 95693
  chr6:45390864-45391547
  Hyper

SEQ ID NO: 126069 - DNA, 16 bp, Homo sapiens
  chr6:45492559-45492575
  Hypo
atggtagaggctgggc

SEQ ID NO: 126070 - DNA, 119 bp, Homo sapiens; identical to SEQ ID NO: 40835
  chr6:45609047-45609166
  Hypo

SEQ ID NO: 126071 - DNA, 85 bp, Homo sapiens
  chr6:45631336-45631421
  Hyper
atcctggtggagctgcggaccatgaacggccacctggacagcatagcgcgggccctcaccaaactggcttcgtccctggggcccc

SEQ ID NO: 126072 - DNA, 265 bp, Homo sapiens; identical to SEQ ID NO: 95696
  chr6:45982726-45982991
  Hyper

SEQ ID NO: 126073 - DNA, 468 bp, Homo sapiens; identical to SEQ ID NO: 95697
  chr6:45983215-45983683
  Hyper

SEQ ID NO: 126074 - DNA, 203 bp, Homo sapiens; identical to SEQ ID NO: 95698
  chr6:46138598-46138801
  Hyper

SEQ ID NO: 126075 - DNA, 207 bp, Homo sapiens; identical to SEQ ID NO: 95699
  chr6:46161493-46161700
  Hypo

SEQ ID NO: 126076 - DNA, 922 bp, Homo sapiens; identical to SEQ ID NO: 95701
  chr6:46702603-46703525
  Hyper

SEQ ID NO: 126077 - DNA, 16 bp, Homo sapiens
  chr6:46951843-46951859
  Hypo
ggagtcttgctctgtc

SEQ ID NO: 126078 - DNA, 93 bp, Homo sapiens; identical to SEQ ID NO: 95703
  chr6:47202360-47202453
  Hypo

SEQ ID NO: 126079 - DNA, 127 bp, Homo sapiens; identical to SEQ ID NO: 95704
  chr6:47539998-47540125
  Hypo

SEQ ID NO: 126080 - DNA, 32 bp, Homo sapiens; identical to SEQ ID NO: 95706
  chr6:47924450-47924482
  Hypo

SEQ ID NO: 126081 - DNA, 43 bp, Homo sapiens; identical to SEQ ID NO: 95712
  chr6:48951303-48951346
  Hypo

SEQ ID NO: 126082 - DNA, 89 bp, Homo sapiens; identical to SEQ ID NO: 95713
  chr6:49002323-49002412
  Hypo

SEQ ID NO: 126083 - DNA, 172 bp, Homo sapiens; identical to SEQ ID NO: 40837
  chr6:49464924-49465096
  Hypo

SEQ ID NO: 126084 - DNA, 424 bp, Homo sapiens; identical to SEQ ID NO: 95719
  chr6:49518576-49519000
  Hyper

SEQ ID NO: 126085 - DNA, 20 bp, Homo sapiens
  chr6:49576100-49576120
  Hypo
ctcttttttttgagacggag

SEQ ID NO: 126086 - DNA, 164 bp, Homo sapiens; identical to SEQ ID NO: 40838
  chr6:49590413-49590577
  Hypo

SEQ ID NO: 126087 - DNA, 43 bp, Homo sapiens; identical to SEQ ID NO: 40839
  chr6:49590817-49590860
  Hypo

SEQ ID NO: 126088 - DNA, 26 bp, Homo sapiens
  chr6:50207704-50207730
  Hypo
ggcgagcgaggcgtggagcagtgacg

SEQ ID NO: 126089 - DNA, 30 bp, Homo sapiens; identical to SEQ ID NO: 95725
  chr6:50352067-50352097
  Hypo

SEQ ID NO: 126090 - DNA, 424 bp, Homo sapiens; identical to SEQ ID NO: 95726
  chr6:50674326-50674750
  Hyper

SEQ ID NO: 126091 - DNA, 1753 bp, Homo sapiens
  chr6:50681604-50683357
  Hyper
aggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgaggtattattacttttttttttttttttttttgagcgcgcgtgtgtgtggcggcggcggcggtggcggcggtggcggcggcggtggcagcctcccctgtctctaatctatattggaccgttacgtttaattataatctgtctttcgggggaagttaaggaaggaaaggggagaaagttcgttatgacatctgtcgccagggagggcaactctctgccacgttaagaaacatttgccataatgagcgggaaaacataatcttaataataaaaggggggagtgaagagaaagagatagagacggaaagaaagattctcagaaaagcaaagaaaagggactggtggggaagcagtagatgcacaagggggatggggaaaacgcaccccttttggaatgggcttattcaaggaaagggaagcagaaaagagggagtcggattccctccctcgaatgactaaggaagggagcaagttgaacgatttgcacagactggattttttaaaatatatggacaatgattttgagcagcccgggccgaacatctcggcatagacaggcgcagaatttcgatgctggggtctagttagagtggcaaggcgccccgggccagcgctcttttcgggtggactcgttcctctgctacccgcggccccggagtcagttgcaaacctggatcccaacgccaagctccctgcacaagttgggcaggggctgtgtgtgtgtctgtgtgtgtgtgtctgtgcgtgtgtgtgcgtgtgtggtgtcacccgcacctatatagggtgggggattttttttccgctctctcgactgtgaggacgaggccgcccacccccagttcgcctgtttgcaaaggctctctggtgaagacgctgagacccggcttcggctcggcccgagtcctacgcgctcgctttccttggagtgccagagaaagctcctggctccgggagagcggcgccttggttgcaaaatgacaaacctcaagtttttctgctctcccttttccccctcttccttccagatacgtcacgacggatcaaacagctaccgtttgatgcagcttggctgtctggagtcagtagccaattccactgtcgcctattcctcctcctctcctttaacttactccaccaccggcaccgagtttgcgtccccctacttctccactaaccaccagtacaccccgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcaggtaaataagcatgcagcgaatttgtctgctc

SEQ ID NO: 126092 - DNA, 88 bp, Homo sapiens; identical to SEQ ID NO: 95731
  chr6:50684010-50684098
  Hyper

SEQ ID NO: 126093 - DNA, 64 bp, Homo sapiens; identical to SEQ ID NO: 95732
  chr6:50684905-50684969
  Hyper

SEQ ID NO: 126094 - DNA, 161 bp, Homo sapiens; identical to SEQ ID NO: 95733
  chr6:50689869-50690030
  Hyper

SEQ ID NO: 126095 - DNA, 178 bp, Homo sapiens; identical to SEQ ID NO: 95734
  chr6:50690519-50690697
  Hyper

SEQ ID NO: 126096 - DNA, 30 bp, Homo sapiens; identical to SEQ ID NO: 95735
  chr6:50691065-50691095
  Hyper

SEQ ID NO: 126097 - DNA, 767 bp, Homo sapiens
  chr6:50691789-50692556
  Hyper
attaatatctgctgccgtggggggagaggtaacatggggggaggggtaacatgggggaggagggttaggaagggtgagaggctagagaggaagcagcagagaataattctccccacccaactcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatctgtttggctgtaaggcgaacagatcatttattttgctctcaagatttggtctaattatgtcaacaccgacgctacgacgagtggggcggcgctgtggctttggagaggatgcgcgcaccggcccagcgcccggaagcccgctaggaagtattgatcgcacctggagagcgcgcgggacctctcgccacagctgggtgcgttctgagacgggggaggcgcggaggccgtgagtatggctcagaggcagatttagaggctccagggacccgcggctccttggagacagccgccgctgtttcctctgccccagtagcctgggatgagaagagaaaaagctcacccaggctccggcgcttgtctttcccatccagttgcagcacagacggtggcggggtgtgtgtgtgtgtgtgtcggcggggggacctgtcttgtcctaccccgcagttcacaccctgcaacggggtagttgtttt

SEQ ID NO: 126098 - DNA, 30 bp, Homo sapiens; identical to SEQ ID NO: 95738
  chr6:50786551-50786581
  Hyper

SEQ ID NO: 126099 - DNA, 1237 bp, Homo sapiens
  chr6:50787164-50788401
  Hyper
aggacagagaattagcgggaaagaagtagatggctggagatatggatggatagagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtggcgggcgcgggccgctaggtcagacgaaaggtggagggatgcagaggctccccaaagagccgagaaagacacgcgacccctccggatcgggacagctcctgaaagcccggcgcagagccgcctcgaagatcctaagagtgggcgactcacaggcgcggccggcaagctcctgggggactcgggctcggacgagcgcccacaggcagcgcctggcgcccacacctcctgcccccccccgaatcctaatgttggggtgtgtgtatgtgtggaggtatgtaggagagaggaggaggagataagagaggagagggagaaaagcaggagagagcgcgagagagcagagaggagagagattggtcttgttgctgaatgatgcttggggttttccttttctctttgtggttgtgtatcgactgtaacgaagagccgcgcctacgcgcctggtggggattgtttcggttcggcctccttttctttccttaacaggcgggataatggtaaagtccaaggcgctagaactgtcct

SEQ ID NO: 126100 - DNA, 205 bp, Homo sapiens; identical to SEQ ID NO: 95741
  chr6:50789374-50789579
  Hyper

SEQ ID NO: 126101 - DNA, 509 bp, Homo sapiens
  chr6:50791123-50791632
  Hyper
ggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccaggtaaccacaaacaaacaaacaaacaaacaaaaaagaccacgaataaggaatgct

SEQ ID NO: 126102 - DNA, 429 bp, Homo sapiens; identical to SEQ ID NO: 95744
  chr6:50793335-50793764
  Hyper

SEQ ID NO: 126103 - DNA, 192 bp, Homo sapiens; identical to SEQ ID NO: 95745
  chr6:50794608-50794800
  Hyper

SEQ ID NO: 126104 - DNA, 228 bp, Homo sapiens; identical to SEQ ID NO: 95746
  chr6:50798960-50799188
  Hyper

SEQ ID NO: 126105 - DNA, 564 bp, Homo sapiens; identical to SEQ ID NO: 30531
  chr6:50803804-50804368
  Hyper

SEQ ID NO: 126106 - DNA, 108 bp, Homo sapiens; identical to SEQ ID NO: 95748
  chr6:50805738-50805846
  Hyper

SEQ ID NO: 126107 - DNA, 128 bp, Homo sapiens; identical to SEQ ID NO: 95749
  chr6:50808631-50808759
  Hyper

SEQ ID NO: 126108 - DNA, 1054 bp, Homo sapiens
  chr6:50810551-50811605
  Hyper
gagaaaggctgaagtcgggggaaggcaaggctttggggtggaaggggtgcattacctccccacccccgctttcctttcagtcccagctgctcgagaagggagggcgctgggaaaggaaacagagcggaatcgcccacattagcctcgctcttcggtgacccggcgcctctgggcttgtgtgagcgtctcctttctaatgccaatgacaacgacactgagggtgattttctgtgcctcgcccacccctttgcaggcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacc

SEQ ID NO: 126109 - DNA, 385 bp, Homo sapiens; identical to SEQ ID NO: 95752
  chr6:50811816-50812201
  Hyper

SEQ ID NO: 126110 - DNA, 640 bp, Homo sapiens; identical to SEQ ID NO: 95753
  chr6:50813299-50813939
  Hyper

SEQ ID NO: 126111 - DNA, 30 bp, Homo sapiens; identical to SEQ ID NO: 30538
  chr6:50814569-50814599
  Hyper

SEQ ID NO: 126112 - DNA, 397 bp, Homo sapiens; identical to SEQ ID NO: 95755
  chr6:50817023-50817420
  Hyper

SEQ ID NO: 126113 - DNA, 72 bp, Homo sapiens; identical to SEQ ID NO: 95756
  chr6:50817685-50817757
  Hyper

SEQ ID NO: 126114 - DNA, 843 bp, Homo sapiens
  chr6:50818165-50819008
  Hyper
ctgggtaataacacacgctccgggcacagggaccgcgggccaacgaaccgcgcgtgcgccgcgccagcctgcgtcgagccgtcgcacacggctccgggagcccgcgtctaggcacgctctccaggttgccaagcagggtgtcaacaagtgcgcacgcgcggacgcccacgcaggcgcacgcgccgtggcgcccccgggcgtaaccccagctgctgtgacgggccagggctcgcagctcgcctgctagagtttgtggcgcgccctcgggatcagggcactggggtttgaaggggctgcagcgtgggaagccttcaattttttttttttgtaagctgcgtgtgctcagattgaggaagcagttttgtcacacatgttcaacacgttccacgctggtcacaagctagcaaggtcaggtagtttttcgcccacttgttcgaaaacctattagttcctgcccaccctgctcttcgcttttcctcctctctcctaagggctgcagccttctggagctgactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 126115 - DNA, 153 bp, Homo sapiens; identical to SEQ ID NO: 95758
  chr6:50819287-50819440
  Hyper

SEQ ID NO: 126116 - DNA, 48 bp, Homo sapiens; identical to SEQ ID NO: 95762
  chr6:52102871-52102919
  Hypo

SEQ ID NO: 126117 - DNA, 88 bp, Homo sapiens; identical to SEQ ID NO: 40842
  chr6:52156845-52156933
  Hypo

SEQ ID NO: 126118 - DNA, 106 bp, Homo sapiens; identical to SEQ ID NO: 95764
  chr6:52226691-52226797
  Hyper

SEQ ID NO: 126119 - DNA, 125 bp, Homo sapiens; identical to SEQ ID NO: 95765
  chr6:52227751-52227876
  Hyper

SEQ ID NO: 126120 - DNA, 114 bp, Homo sapiens; identical to SEQ ID NO: 95766
  chr6:52268175-52268289
  Hypo

SEQ ID NO: 126121 - DNA, 30 bp, Homo sapiens; identical to SEQ ID NO: 95767
  chr6:52344375-52344405
  Hypo

SEQ ID NO: 126122 - DNA, 180 bp, Homo sapiens; identical to SEQ ID NO: 95768
  chr6:52928858-52929038
  Hypo

SEQ ID NO: 126123 - DNA, 32 bp, Homo sapiens; identical to SEQ ID NO: 95769
  chr6:52929278-52929310
  Hypo

SEQ ID NO: 126124 - DNA, 102 bp, Homo sapiens; identical to SEQ ID NO: 95770
  chr6:53052001-53052103
  Hypo

SEQ ID NO: 126125 - DNA, 30 bp, Homo sapiens; identical to SEQ ID NO: 95771
  chr6:53212219-53212249
  Hyper

SEQ ID NO: 126126 - DNA, 1193 bp, Homo sapiens; identical to SEQ ID NO: 95772
  chr6:53212645-53213838
  Hyper

SEQ ID NO: 126127 - DNA, 30 bp, Homo sapiens; identical to SEQ ID NO: 95773
  chr6:53214185-53214215
  Hyper

SEQ ID NO: 126128 - DNA, 30 bp, Homo sapiens; identical to SEQ ID NO: 95774
  chr6:53438260-53438290
  Hypo

SEQ ID NO: 126129 - DNA, 72 bp, Homo sapiens; identical to SEQ ID NO: 95775
  chr6:53517059-53517131
  Hyper

SEQ ID NO: 126130 - DNA, 514 bp, Homo sapiens; identical to SEQ ID NO: 95776
  chr6:55443691-55444205
  Hyper

SEQ ID NO: 126131 - DNA, 19 bp, Homo sapiens
  chr6:55678574-55678593
  Hypo
acaccgtctcaaaaaaaaa

SEQ ID NO: 126132 - DNA, 433 bp, Homo sapiens; identical to SEQ ID NO: 95778
  chr6:56112173-56112606
  Hyper

SEQ ID NO: 126133 - DNA, 41 bp, Homo sapiens; identical to SEQ ID NO: 95779
  chr6:56407898-56407939
  Hyper

SEQ ID NO: 126134 - DNA, 49 bp, Homo sapiens; identical to SEQ ID NO: 95780
  chr6:56707974-56708023
  Hyper

SEQ ID NO: 126135 - DNA, 279 bp, Homo sapiens; identical to SEQ ID NO: 95781
  chr6:56708790-56709069
  Hyper

SEQ ID NO: 126136 - DNA, 508 bp, Homo sapiens
  chr6:56716187-56716695
  Hyper
ctcttacctgctatccgaagcactgccctctcggcagggtccagcactgagcccccttgaatctttcttttcgatctctcatgtttaggcaaattccagggtaaggtgtctcccggagctggggatgcggagccagatttctggctgaaatcatcctcatcggaaaaatccgcagaggaagacatagagcagcgataggacgcgttcccggaactctacagagaatgacacagaaaaagcattaacagcaaaatactcacatatgctcaatgatttaaacatctcccccaccaaccaccgccgccctccctgcccccaaactgggtctggcatatcctgcaccatcctcggagctgagggaatatgcagaaaccaaaaaaataaaacccggagctcaccatcttttcttggccaagtctccaatcgtaaaaacaatacacaggcagtttcaatacatgaagatttgcacggaagaagtgtgtggcctgtggtccggccaccagctcac

SEQ ID NO: 126137 - DNA, 1567 bp, Homo sapiens; identical to SEQ ID NO: 95784
  chr6:56818703-56820270
  Hyper

SEQ ID NO: 126138 - DNA, 144 bp, Homo sapiens; identical to SEQ ID NO: 95785
  chr6:56820756-56820900
  Hyper

SEQ ID NO: 126139 - DNA, 81 bp, Homo sapiens; identical to SEQ ID NO: 95786
  chr6:57694608-57694689
  Hypo

SEQ ID NO: 126140 - DNA, 30 bp, Homo sapiens; identical to SEQ ID NO: 40846
  chr6:57979515-57979545
  Hypo

SEQ ID NO: 126141 - DNA, 91 bp, Homo sapiens; identical to SEQ ID NO: 95789
  chr6:57985540-57985631
  Hypo

SEQ ID NO: 126142 - DNA, 98 bp, Homo sapiens; identical to SEQ ID NO: 95790
  chr6:58002802-58002900
  Hypo

SEQ ID NO: 126143 - DNA, 219 bp, Homo sapiens
  chr6:58147419-58147638
  Hyper
tggcgtgcagaaaaccgcatctcccgaaatcccagaacgtaaacgtcgcccaggtactcgctctcttgtcattctccgggatgtaaaagactcggggtctcttcacggatcactgaaaccgccttctccgaggcctccagggtgactaaaagaaagggtgcgtgttctgtgttctcccgccggtgtgttcctcttcatgtccagccgcttgtgtctgtg

SEQ ID NO: 126144 - DNA, 218 bp, Homo sapiens; identical to SEQ ID NO: 95792
  chr6:58147758-58147976
  Hyper

SEQ ID NO: 126145 - DNA, 39 bp, Homo sapiens; identical to SEQ ID NO: 95793
  chr6:58148912-58148951
  Hyper

SEQ ID NO: 126146 - DNA, 22 bp, Homo sapiens
  chr6:58149309-58149331
  Hyper
cgatccccgtacgggccacagg

SEQ ID NO: 126147 - DNA, 57 bp, Homo sapiens
  chr6:58180231-58180288
  Hyper
ccgcagccctggagccgggcagtgagcgcctgcgcggcgctgcgtcgctgtccagga

SEQ ID NO: 126148 - DNA, 35 bp, Homo sapiens; identical to SEQ ID NO: 40847
  chr6:58504069-58504104
  Hypo

SEQ ID NO: 126149 - DNA, 148 bp, Homo sapiens; identical to SEQ ID NO: 95799
  chr6:58588027-58588175
  Hypo

SEQ ID NO: 126150 - DNA, 30 bp, Homo sapiens; identical to SEQ ID NO: 95816
  chr6:62692207-62692237
  Hypo

SEQ ID NO: 126151 - DNA, 27 bp, Homo sapiens
  chr6:62849167-62849194
  Hypo
ttcatatgggccaggcgcagtggctca

SEQ ID NO: 126152 - DNA, 1355 bp, Homo sapiens
  chr6:62995356-62996711
  Hyper
taaaaataaaaataccgatctgtagctacgaagctcttagaacactacattgatcaccatttacttccaaactgctttcccttccctctgcgaagtgaaaatgtccctgtagaccgcgttacatacactttatggtttctctatcaatgatcctaacaggtcacatcgccactgccattagatctccgtagctttggtcttctccaaattaagacgtggagaaggagcactgctgtccgccccaagaacggggtctgtccgcccgagctctaaggcgagcatcttcagggggacagtttctgcgaaggcggggagaggagtccctccccaacttcactcccctaatcaagccgcgggtgagataggcagccggcggtttgtgcccatctgtgggggcaagtcctaccttctgccaaaaggcgcgacgcatgcacaaaagatggatccaggctatctttctctgccatcagctcaggcaaatatttctcctcttccatagcgcggacttcggattgtccccgggcgaagcgcgaggttccgctcgctcggacgcaggcagggtcttggggcagcgcctggctcccgcgctgctcctcctccgcgcggcgagggatctctgtgcgtcctcactggcccatgcacccagcacctgcgactcccgccgtcgggctgcgtggccccgcgcccacacctgcccgtcccttccgtcgtccctcgctcgcgcagagccccggctcacaccagcggccttaactggagaggcgggaacaggacgcggcccacctccgccaaccactcattggtggtggtgccaggagaggcggggcgctggcagaaggccgcgggctctcattgggcggtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagatgagaagtgagccacccgagagggtggaaaagcgccagggaaagtctcaggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtatttccgatgacctacatctcagggacgcagtaggatgttcattgataaacaaataaagcggctcgaagaaata

SEQ ID NO: 126153 - DNA, 30 bp, Homo sapiens; identical to SEQ ID NO: 95822
  chr6:63080264-63080294
  Hypo

SEQ ID NO: 126154 - DNA, 83 bp, Homo sapiens; identical to SEQ ID NO: 95824
  chr6:63983649-63983732
  Hypo

SEQ ID NO: 126155 - DNA, 155 bp, Homo sapiens; identical to SEQ ID NO: 95825
  chr6:64150663-64150818
  Hypo

SEQ ID NO: 126156 - DNA, 68 bp, Homo sapiens; identical to SEQ ID NO: 95826
  chr6:64734852-64734920
  Hypo

SEQ ID NO: 126157 - DNA, 34 bp, Homo sapiens; identical to SEQ ID NO: 95827
  chr6:64921720-64921754
  Hypo

SEQ ID NO: 126158 - DNA, 326 bp, Homo sapiens; identical to SEQ ID NO: 30560
  chr6:69344323-69344649
  Hyper

SEQ ID NO: 126159 - DNA, 1099 bp, Homo sapiens; identical to SEQ ID NO: 95835
  chr6:69344943-69346042
  Hyper

SEQ ID NO: 126160 - DNA, 370 bp, Homo sapiens; identical to SEQ ID NO: 30563
  chr6:69942843-69943213
  Hyper

SEQ ID NO: 126161 - DNA, 38 bp, Homo sapiens; identical to SEQ ID NO: 95837
  chr6:70310230-70310268
  Hypo

SEQ ID NO: 126162 - DNA, 38 bp, Homo sapiens; identical to SEQ ID NO: 30564
  chr6:70576959-70576997
  Hyper

SEQ ID NO: 126163 - DNA, 344 bp, Homo sapiens; identical to SEQ ID NO: 95841
  chr6:70577295-70577639
  Hyper

SEQ ID NO: 126164 - DNA, 1158 bp, Homo sapiens
  chr6:70991963-70993121
  Hyper
ttttctaaactccaacgaccaaacaggttacaatggggtctttgtaagtgaaacctcaaacctcagctgggcttatgcgcccccgccgggtcctccctcgcgcaggaggcgggaggcgctggagcctttgggaaactgctgaaatgctgatggaagccagggccgccaagttccgtcccggagccgccagcaccgctagctggactcggggttagtgcagctacggcgggctggaggagcgggagagggagcgtgcctggattcccgccttttccagcaaggcctgctgttgacagtgaccaggaggtggggcgggggagggggtgaggtgcgggaagtaagaagcaataacaggctaagaattaaacctcggtctccagtcacctattaccttcagcgccagagcctgcagtagggaggacccagattggggaggagccccccttcctagaccaaggggtcatctacggctctggacttcgataggactcgcggcaggtgctcgaggctggaggaagcgcgggtctgagagccctggggatgctccgcgcctttctcacagctccctcgaccgctgcgccccgacctgtcctcgtgtgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccactagcataggtggcacttcgtccctgcagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctccatcccatccaccccagtgcagcttctggctgtcctcggagacttcccgggtggcctgtgcc

SEQ ID NO: 126165 - DNA, 29 bp, Homo sapiens
  chr6:71122509-71122538
  Hyper
aatcaatgatccttcgtgggcttctgtta

SEQ ID NO: 126166 - DNA, 30 bp, Homo sapiens; identical to SEQ ID NO: 95847
  chr6:71277663-71277693
  Hypo

SEQ ID NO: 126167 - DNA, 107 bp, Homo sapiens; identical to SEQ ID NO: 95849
  chr6:71589506-71589613
  Hypo

SEQ ID NO: 126168 - DNA, 217 bp, Homo sapiens; identical to SEQ ID NO: 95850
  chr6:71665506-71665723
  Hyper

SEQ ID NO: 126169 - DNA, 1041 bp, Homo sapiens
  chr6:71665945-71666986
  Hyper
tcccgtgagccgggccgcccctgcggagcgggagtcgggcgcccccgcggcccaccgcgtagggagagaagtaggggcgcggggtgagcgggggcactggcctgcgcgtgtccacgtcgagcatgatgatgacaattaggatccagggcaggaggataaagaagcgggtgaaaagcgcggacttcatggtgcacgctccctggcctctcggacaccccagagaggggcgagccgagggaccccagtgcgcagcttggacagcggcggcgccagcacttagggagtggtgatgggtgcgctgtccatggggccgagggcgctgcagagacctggagccgcggggctcactacctgggcgtggaggagcggcaggttcgcgcaagctagagcgacaaggggtgcaggcgggcgggcaggggctgcccccgactccaggtgagctggcgggaagcgggactcggtccagccgcgcgccgccggtcccggagttgtgccgagtgcgggaaaggcgctgatccccaccgcgctctttctgaagagtggaagccgagaagcggcacccggtgcgcctcgccgctccagtccggcggtgctgcgggcacaagggctccagccgcgggcccccaggacgctctctgggacgccttcgagggcgggcggcggcgctgggggctttccttcctcacattcccgccggggtggcgaggagcgggtggagacgctgggggttgtgtcccggctgtgttcgcgcgccgcagcggaagcctgctctcagtcccttgctcttgtcttctcagaacctctccggatccagcagcaagatcccaaagcaaggaaagaaagaaaaagcgagggggcgggggcgctgcagaatccagcgtcctcccaagtcctcctgtgggaagacagcagcgctgctactggtggagaggggctgcgagagggaggcgcggagggaccccttggctctccgccgggtctggcgctaacggccccgcgagcaagctcgggaggcggccgctgcaccgcgggtggaggagc

SEQ ID NO: 126170 - DNA, 30 bp, Homo sapiens; identical to SEQ ID NO: 95853
  chr6:71868836-71868866
  Hypo

SEQ ID NO: 126171 - DNA, 22 bp, Homo sapiens
  chr6:71955640-71955662
  Hypo
atttgtgtctgtgcccgctacg

SEQ ID NO: 126172 - DNA, 805 bp, Homo sapiens
  chr6:72129732-72130537
  Hyper
aaccacttgagcccacggcgcctaaagccgactcacccgcagcccgaggtgcgggagccctcggacggactccggcccgccccgcagtccccaccggccgcgctgcggccccggctgacgacgagtcgagaaagtcacccgcgatgaccgcggacgcgaggggcgggccgcgtcgcgccgccccgcggaggcgccgcaaacttttcccggttcgcaagttgccgggatctgcggccgcggaccgacttccttcgccggccaccggagggagggggcgcccctaccccgggagggggctgggcgagccgggagacggtcaagttggggtcgggggagcgcgggcgctccgcactctggggcacgcggggacgagcccggccgcattgtctgcgcggcctcggaacaagcacggccggcggtggcaccggcgggcgcggggaggagttgccgtcccctttcgccgccgccgcccaccgcgttctttgtgtgtctctcgccgccctccagccgcttcgccgctcgcctgacagctgatgggctcaccgcgccgggtcccgcgtcctctcggccgcagccggcggagcccggcccggcaggaggaggaggggagaagaggagcgttgacagatgctgtcttggagcgggcaccgccgggggaaaagtctggactgcctcggcgagaagcggccggtaggcaaccggccccagcctcgcattcgcctcaaagaccccaattggctaggagcccttccctccgcagcggctcgcgcagctccgctcttgcgccccgcgcccggctcagcgg

SEQ ID NO: 126173 - DNA, 280 bp, Homo sapiens
  chr6:72596035-72596315
  Hyper
gcgaggtgctgtgcacgttggcgactgtaggggtagcggccggggcacgcgtggctcggacccggggagtgggcgggtgggtgcccgtgggcggagcggcgccgggactgagtggctggcagctatgtctgcgagagcagcggcatcaccctggatggaagcctctgagactccgcctaactgacacccaaactctccctctccctcccgcagccccaaattggaggcagcagagcctgggagcagcctccacggcggcagcggccgccccagtcccagc

SEQ ID NO: 126174 - DNA, 543 bp, Homo sapiens; identical to SEQ ID NO: 95863
  chr6:72596541-72597084
  Hyper

SEQ ID NO: 126175 - DNA, 30 bp, Homo sapiens; identical to SEQ ID NO: 95865
  chr6:72806875-72806905
  Hypo

SEQ ID NO: 126176 - DNA, 30 bp, Homo sapiens; identical to SEQ ID NO: 95866
  chr6:73063627-73063657
  Hypo

SEQ ID NO: 126177 - DNA, 342 bp, Homo sapiens; identical to SEQ ID NO: 30579
  chr6:73329784-73330126
  Hyper

SEQ ID NO: 126178 - DNA, 2471 bp, Homo sapiens
  chr6:73330620-73333091
  Hyper
gaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcccagacactgggtcctcgccgccgctgctgaacttctcaatcatatgactttctcggacttaaatggaaatttcttgacggagggaactgggtttgttctcccaggcttcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgcgggaagatgcctggtccttgcctcgcggacttggcagccgcgtcctgcgggtctgtccactgaactgctgaggactcgcccgtgtgcggggacccgagtgccacttcccggagcgttaccttgcgctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaa

SEQ ID NO: 126179 - DNA, 179 bp, Homo sapiens; identical to SEQ ID NO: 40850
  chr6:73764839-73765018
  Hypo

SEQ ID NO: 126180 - DNA, 489 bp, Homo sapiens; identical to SEQ ID NO: 95875
  chr6:73972632-73973121
  Hyper

SEQ ID NO: 126181 - DNA, 681 bp, Homo sapiens; identical to SEQ ID NO: 8540
  chr6:74019413-74020094
  Hyper

SEQ ID NO: 126182 - DNA, 144 bp, Homo sapiens
  chr6:74161177-74161321
  Hyper
ggaaggtagggactgcggattgcggaaggccgagcagcggggctcggcgggagggcgccaagcagctcaccttcacgtgctcatagtagctcccggtgttcagcagcccgacgcctctgaacgcggagtcgcacttcagtctga

SEQ ID NO: 126183 - DNA, 438 bp, Homo sapiens
  chr6:74161627-74162065
  Hyper
gctgcgtgtcctgggcgcgctgaggggcctttttggcgcgggccccagttgcgcggacgggcggcctctcctgggtgtccggggcgctctttttctgccgggatcccgacttcctggcggggccgaactttcccgccttaggcagggcggcctcgggggcagccggagactcggtgggatccatcggggcgcccctggcattccgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaaccccaggctgggaagtcgctgggagccacgc

SEQ ID NO: 126184 - DNA, 100 bp, Homo sapiens; identical to SEQ ID NO: 95881
  chr6:74234126-74234226
  Hypo

SEQ ID NO: 126185 - DNA, 38 bp, Homo sapiens; identical to SEQ ID NO: 30589
  chr6:74405585-74405623
  Hyper

SEQ ID NO: 126186 - DNA, 102 bp, Homo sapiens; identical to SEQ ID NO: 95883
  chr6:74405913-74406015
  Hyper

SEQ ID NO: 126187 - DNA, 38 bp, Homo sapiens; identical to SEQ ID NO: 95884
  chr6:74406224-74406262
  Hyper

SEQ ID NO: 126188 - DNA, 93 bp, Homo sapiens; identical to SEQ ID NO: 95885
  chr6:74698077-74698170
  Hypo

SEQ ID NO: 126189 - DNA, 30 bp, Homo sapiens; identical to SEQ ID NO: 95886
  chr6:75167870-75167900
  Hypo

SEQ ID NO: 126190 - DNA, 52 bp, Homo sapiens; identical to SEQ ID NO: 30591
  chr6:75914106-75914158
  Hyper

SEQ ID NO: 126191 - DNA, 138 bp, Homo sapiens; identical to SEQ ID NO: 30592
  chr6:75914461-75914599
  Hyper

SEQ ID NO: 126192 - DNA, 1108 bp, Homo sapiens
  chr6:75914881-75915989
  Hyper
gagctgggaaaagtccgccaagaatgagtaccctagtgctgcctaacccaccatctcggatgctctgaaaggtaggggaggaaggagccagaacactccactaggaatctgttacgagatgccacacacacccgtgcagcctcgacgagctgcagagcactcagcgggccctccaaagaattccgcaccgtgcgtcaccaaaataccttcccagcgcccccgccgcacgcctgccctccccgacaaagccacagccgcgagataaccagggccctgctgccccagaacccggcgcgccctccattgaaatcgacagcatctacagatgaaactcctctagaaacggaaacactgaacgggatgctttgcgtgcacaaaaccttgctcagctcttaagaaaagcaacattcccctctccctcaaaaaccccaaagaatcaccaaatcccagtatacaaggcaacgctctagcccacctacactattacaagtccaaactgtcctcgcccaggattcttcaccgctccgggcaaggtgcaagctagacgccgtttcccgagttgtctctgggaatgatgggggtaggggaaaggggacagaaaccaggctgacctgaggcggcggcaacagggagaggtagcggcggcgacagcggcttcccggcgtcggagaagctggtgctcggtgtggcccccacacgccccggcgataggcgctgcactccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcgagcattccttcggcgtgaggtggcgatcgccgtagtagcagtgccccgctggggggcgggg

SEQ ID NO: 126193 - DNA, 190 bp, Homo sapiens; identical to SEQ ID NO: 95894
  chr6:75916269-75916459
  Hyper

SEQ ID NO: 126194 - DNA, 40 bp, Homo sapiens; identical to SEQ ID NO: 95895
  chr6:75918553-75918593
  Hyper

SEQ ID NO: 126195 - DNA, 17 bp, Homo sapiens
  chr6:76006457-76006474
  Hypo
cccgcctcagcctccct

SEQ ID NO: 126196 - DNA, 27 bp, Homo sapiens
  chr6:78061285-78061312
  Hypo
agaaatactgctgggcgcagtggctca

SEQ ID NO: 126197 - DNA, 1038 bp, Homo sapiens
  chr6:78172176-78173214
  Hyper
gtcttggtggctttgcgctccctagcggccatgagtttcttcttttccagcagggcgtcggagactcgcactttgacttggttcacatacacaggagatccggattcgctgggcacgtcgggaacccgcgagttaatagaggtgaccgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgtgtagaggatgtggtcggtgttcaccacgcattccgacacctcctcttcggccttagcctgacgccagaagaagggcggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggcatggagcggacgaaggagagggcggaaggaccgtggcgatcgcaggtttgtcccc

SEQ ID NO: 126198 - DNA, 355 bp, Homo sapiens
  chr6:78173701-78174056
  Hyper
ctaggagcagcgctgcgccgcgcctcgcgccggagctctgccctccctctcttttcactctctggccactcggacgagctgccccgcggagacggagccataaaaggggggacacgggggctggagttgcggctgctcgggccgcgccgccgccaccgccaccctggtcccacgggagccactcggagccatgccactgggtgcgcgggtctggaggacctggcgcggcacactgggaaggggcaggtgtctgggggagctggagggacgcggcgtgcaccagcccgggagaagcgtgcgagctacggagcagatgggctctttatatagagtccaggtccggtccgccagagca

SEQ ID NO: 126199 - DNA, 234 bp, Homo sapiens; identical to SEQ ID NO: 30600
  chr6:78175915-78176149
  Hyper

SEQ ID NO: 126200 - DNA, 84 bp, Homo sapiens; identical to SEQ ID NO: 30601
  chr6:78176445-78176529
  Hyper

SEQ ID NO: 126201 - DNA, 44 bp, Homo sapiens; identical to SEQ ID NO: 30602
  chr6:78176790-78176834
  Hyper

SEQ ID NO: 126202 - DNA, 606 bp, Homo sapiens
  chr6:79620288-79620894
  Hyper
ggaaatggactaggtcgtaacaagaaaaagtgatatcaagcccgggcagaagggcgcattctcggcgcggagggcggagcctttcctggagtggcggcggatgacccgggctcccgctcctcacctcggcgtggggcgcaggcggcggccgcaaggaccgcggatgcttgaatcgcgcttctcgccggctgggactgccccagacacgcacaccctcccgacctccgccctgtcgcagttccagggcgctccgcgctgtcatgattgctgggtgcgcgctccgtgctgggacagccgcgcaccaacagcggagggcgttagcaccccaagacgctgctgcaggggtctgaaccgctccttggcctactggcaccgggtcctggacgaaatctaccgcggtccaactgagctttatcttgtgcggtgacgcccatgcctaggtcttgacacttccctcctatgccctttattgccaagggtcgggatggccttcgtgtcctctgcagcctccgccttccttctgctgccagcagctgtagattttacctctttcccctaacttcctctcaggctcctactccattcctatcgcgactgcttgagacc

SEQ ID NO: 126203 - DNA, 30 bp, Homo sapiens; identical to SEQ ID NO: 40853
  chr6:79699310-79699340
  Hypo

SEQ ID NO: 126204 - DNA, 52 bp, Homo sapiens; identical to SEQ ID NO: 95915
  chr6:80341274-80341326
  Hyper

SEQ ID NO: 126205 - DNA, 1078 bp, Homo sapiens; identical to SEQ ID NO: 95916
  chr6:80656522-80657600
  Hyper

SEQ ID NO: 126206 - DNA, 265 bp, Homo sapiens; identical to SEQ ID NO: 95917
  chr6:82461332-82461597
  Hyper

SEQ ID NO: 126207 - DNA, 30 bp, Homo sapiens; identical to SEQ ID NO: 95918
  chr6:82462799-82462829
  Hyper

SEQ ID NO: 126208 - DNA, 31 bp, Homo sapiens; identical to SEQ ID NO: 95919
  chr6:82958615-82958646
  Hypo

SEQ ID NO: 126209 - DNA, 43 bp, Homo sapiens; identical to SEQ ID NO: 95920
  chr6:83073208-83073251
  Hyper

SEQ ID NO: 126210 - DNA, 71 bp, Homo sapiens; identical to SEQ ID NO: 95921
  chr6:83073519-83073590
  Hyper

SEQ ID NO: 126211 - DNA, 32 bp, Homo sapiens; identical to SEQ ID NO: 95922
  chr6:83073803-83073835
  Hyper

SEQ ID NO: 126212 - DNA, 312 bp, Homo sapiens; identical to SEQ ID NO: 95923
  chr6:83074517-83074829
  Hyper

SEQ ID NO: 126213 - DNA, 88 bp, Homo sapiens; identical to SEQ ID NO: 95924
  chr6:83458754-83458842
  Hypo

SEQ ID NO: 126214 - DNA, 1986 bp, Homo sapiens
  chr6:84417429-84419415
  Hyper
attatggaccaagagcgcaggccgcaccaccagcatcccaggcgcctctgccgtgcgcatgtccctcttatataaagagatgcttacagtccaggtgctttttcttggggcccattacttcatgagtagtggctttgcagaccgctcttgctacagcagagcctgtaacgctgtactgagcggcggcgatccgatccgtgagcgtttggcccgacatcttctgtggtcgcgtctaccgcctcctcttctgcaggaaacaaggggagacggtccggctttaatccgcagaccctaccctccaagcacccaggccttgcctcctccagccgcgcggcggctctctcctcctccatccccaccctggcaccacctctcggagccagcaacgcgccaagccccgctcctgcgatgcggtccagggagtcttggccgtgagtagggccgtcacggaaccccagcgtgggctccagtcgcagcatcgtgacaccgtccccattctcccccggcccccacatagggccagactcaccccctggggacccccctgtcaatcagcactttccccgcaacctgacccgcgggtgctggactagccacaacgtgcgttggggttattccctgggcgccgcacccaccggtgcccatctcccacctcagcagactttcctcctagcagcccgcaggcttcggggaatgcatcggatacccaagccctggctgcctccctcctcctcctcgcgctgctgcagcaaagggctcgtcctccctcagtcgcgaaggagattatcctagcgttgcgccatgttatgccctcgcctccccttccttcctcgccgccggctccaaagcctcgccgaggcccatcgcccgggccccttccccccggttccaaatccctgccgcaggggccgcccgggagctctgcggaggcgccggagtcttggggcgcctcacccttcctggctttggagaggagccgggctgacagcgaagcccagtcccccgcccgccctggagcgctccgcggagctgtcactcggccgctgcccttctccgcaccctgggattatcctctgcggatccccgcgagaccctggcgcggggagggggccgagtacggccgcgggtactcaccccgcccctgagcggcgccgcccgccgcaggatgagcggagcccgggccgccgagggaagccgcgccggtggatgtgtgcgaccgcgcgtagccccggtgcccccgggcgcaaagtctccagccctggccgggccccgctcctcagctccgcggtcccggcgcccaccgcccctggcccctggccccagaagccagtacccgcccgccgccgcctcttctgccagcgccgccgcgtctctctagcgctccgagctgcgtccccatccccgcccccacctcagctgtggctcctccgacgagtcaggtgacggcggcggacaaacccggacgagccctcggcggagcgcctcgcggccccctcccagctactcacacacaccgccccccggggccgggagcttaaaggcgagggggcgcctcgcgcaagcatccccggcaagccggcggggagaagaaggaggcggggaggccgacacccacccagccagcggctctccgctgggcgccgggccgcccctccgctgctggcgccgcacccggcacgcactgggctcgcgcaccacgcacacctgcccgccgactgcggggggagccctgggcgttgggggcgttggccaagacgggcgagtgggcttctcgggttctactctgtgaaggccaaggcaagggcgtcgtcgcgcgctgcctggcggagcccagccccttccccacactgtcgctgacacgcccgcctgtcaaaggctccgaggcccagatgagcagggcgattttaaatgtcagatcctgccggccatccgcgaccgtcacctgtgcgtcttcagctcctcaggctcctccgcttgtctcagtta

SEQ ID NO: 126215 - DNA, 79 bp, Homo sapiens; identical to SEQ ID NO: 40855
  chr6:84513478-84513557
  Hypo

SEQ ID NO: 126216 - DNA, 1142 bp, Homo sapiens
  chr6:84562711-84563853
  Hyper
gtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgcgttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccgggtaggcttccccgcgctgctctgcgcctcccagcttcccccgtctctccctcctgcgcctccccagctcctcccctccaactctccatcccccactgcccggtgccagcgctcggcttcggtggattctcccgggtctgggctcacgtctcctctgcgcgccttgtgctcccctatcccgcagatacgcaggcttctggagaccctgggtggacgccggaggcaagaaagaagaggagacgccgaaccacgccgcggaggcggtgagtgagccacgcgtctcaggccgcgcctcccacgggtgcagaagatcgaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaa

SEQ ID NO: 126217 - DNA, 66 bp, Homo sapiens; identical to SEQ ID NO: 95936
  chr6:84743425-84743491
  Hyper

SEQ ID NO: 126218 - DNA, 30 bp, Homo sapiens; identical to SEQ ID NO: 95937
  chr6:84847017-84847047
  Hypo

SEQ ID NO: 126219 - DNA, 39 bp, Homo sapiens; identical to SEQ ID NO: 30618
  chr6:85471957-85471996
  Hyper

SEQ ID NO: 126220 - DNA, 2365 bp, Homo sapiens; identical to SEQ ID NO: 95939
  chr6:85472324-85474689
  Hyper

SEQ ID NO: 126221 - DNA, 39 bp, Homo sapiens; identical to SEQ ID NO: 95940
  chr6:85474894-85474933
  Hyper

SEQ ID NO: 126222 - DNA, 60 bp, Homo sapiens; identical to SEQ ID NO: 95941
  chr6:85475862-85475922
  Hyper

SEQ ID NO: 126223 - DNA, 211 bp, Homo sapiens; identical to SEQ ID NO: 95942
  chr6:85476191-85476402
  Hyper

SEQ ID NO: 126224 - DNA, 267 bp, Homo sapiens; identical to SEQ ID NO: 95943
  chr6:85476998-85477265
  Hyper

SEQ ID NO: 126225 - DNA, 38 bp, Homo sapiens; identical to SEQ ID NO: 95944
  chr6:85478418-85478456
  Hyper

SEQ ID NO: 126226 - DNA, 200 bp, Homo sapiens; identical to SEQ ID NO: 95945
  chr6:85478694-85478894
  Hyper

SEQ ID NO: 126227 - DNA, 30 bp, Homo sapiens; identical to SEQ ID NO: 95946
  chr6:85481458-85481488
  Hyper

SEQ ID NO: 126228 - DNA, 396 bp, Homo sapiens; identical to SEQ ID NO: 95947
  chr6:85482401-85482797
  Hyper

SEQ ID NO: 126229 - DNA, 2076 bp, Homo sapiens
  chr6:85482857-85484933
  Hyper
gtgtaaaatcaaaaaagacttgggaggcaaacttgggtgggaagcactgaggaaggcgaaacaattcccaacttatctggatcccagacgagtccctctgattgcttaagtcactagaaaaggagattcgtctcagcgattaacaatgataccctttttaagagagatcaaagaaggcgcctagggaagctctacaacgcggcttcttggagttctgaggccgcctgcgcattcactttccagtgtaagcccccgctccggaatcccggctccagcccagcccgcgcccccttccctggaaagacctggccggccgcgcccccgaacccccgaggcgtgggtgtcaggctaagcggggctggtccgaccggtcgcttccagctctctccacctgttggaaagcccaggcccaagaaccgcgccagcggcggcagcacgtcactcggcggccacggggagtcagggagcgcggaacgcgggtttctgttgataagtgcaaagtacggccctctcggtgctaagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggccgagaagggcgcgcagccacagccaccacatgccactagccccgcaaggcgcctgactcctctaaggggaactcgtaatgctcaccaaaagcctcagaaaccctggaacctataagaccgcaccaccgcgcaaacggtgtcccgggctgcgctcccgcactgcaccggcagcctatgaggcgaggccaacccggagactgcgcgcgacgggcgtgcgtgcgtgcgcccgcagattcgcttcaggcggtaggtgtggagtacctgggcagctccggcgggaatggtgttggggagaaggagctgtcattcatagtcttctacatatctgaataaagaattgctttttaaaaataggttcagagcctagtgagtgaaaacttaaaagtccccgcgaggagctctagttcccgggcggcgcggccccgactttctcgtcggtagcgctctggccttgggcgcccgccgctttggctatggaggtacagtggccgcgtcccggggagcctgggcctccttgcggctccgagcctccgcggcgcccgcgccccgactctccggtcccggctctctccaggcccggctgtctccggtccctcactgacttcgccagccgcaccacccacctctttctcccgcagacgtaaacccgaatacgccccggccttgggcctagggcctcggcctcgcctggctctacaggattcgggggcggggtaggccggcagagctcagctcgcgccgtgggtccacatgtttttatttcgtgaccctgaccgcgtcccggccataacttcctctgcgttacaacggggataataatccccggccggcctgccggatggtggcgggataatatatcccggtgagggaaggaccgagcttggcagagacacttaactgtcccactgtgtggctgttcacagtccgcccagatttaggggtgggatggggggttttcgggccccggcctgctccccctctccagaccccgcagaaaggggttcatgggcaattaggttccgctggactcgccgggctgcgggcgggtgagcgccgccgggcaccgggcgggggcacgtggcgccctctggggaccgtccgccgcactgcctggcgtcctgcctggggaggcgcagcctagcccagcacctcccgccgtctcaggctcggaggagctctgtacctggctccgcgctgacccctccacctggctgaaggcagcagccctgggagactctggcactctgggccggagcaggagctgtgccccatggcaacccagactgaaagggaagccctgtctgttgctctttgctgcggattcgagggaggccgtctcgagtcgctcagaagcgacctaaagaaggcactggcctctgtgcgccgaacctccacgagatagactaagt

SEQ ID NO: 126230 - DNA, 61 bp, Homo sapiens; identical to SEQ ID NO: 95953
  chr6:86159448-86159509
  Hyper

SEQ ID NO: 126231 - DNA, 125 bp, Homo sapiens; identical to SEQ ID NO: 30627
  chr6:86159778-86159903
  Hyper

SEQ ID NO: 126232 - DNA, 262 bp, Homo sapiens; identical to SEQ ID NO: 95955
  chr6:86160146-86160408
  Hyper

SEQ ID NO: 126233 - DNA, 77 bp, Homo sapiens; identical to SEQ ID NO: 40856
  chr6:86302345-86302422
  Hypo

SEQ ID NO: 126234 - DNA, 30 bp, Homo sapiens; identical to SEQ ID NO: 40857
  chr6:86415082-86415112
  Hypo

SEQ ID NO: 126235 - DNA, 84 bp, Homo sapiens; identical to SEQ ID NO: 95958
  chr6:87646860-87646944
  Hyper

SEQ ID NO: 126236 - DNA, 363 bp, Homo sapiens
  chr6:87647217-87647580
  Hyper
ccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttccc

SEQ ID NO: 126237 - DNA, 27 bp, Homo sapiens
  chr6:87770042-87770069
  Hypo
cgcaagaggctacgttttccattccaa

SEQ ID NO: 126238 - DNA, 761 bp, Homo sapiens; identical to SEQ ID NO: 95963
  chr6:87861548-87862309
  Hyper

SEQ ID NO: 126239 - DNA, 2159 bp, Homo sapiens
  chr6:88875382-88877541
  Hyper
cagctaagtaaacaccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctctcgcccagctcaggggctggttgtccgctagaacgaaatatcccccactgactacggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgccgcggcgccagccctggggccagaggggacaagcctcttcggcccgcgtcacctacttctcctcttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttccgcgggggtcacgtctggggcagcgggctgagccggaaggggaaggggagcgggagcccagaggccgaggcgcgccgggcccgggggtgcggtctcgcgccccctccctccgcgcaaggccgctcccgtggcaggcggcagcgagctgggcccggggccgggctgagctttgggaccgcgctgcgcagcccccgagccgttcgctacctggctgcggtcgcgcggccacctgtcctccgccctcggggcgccgcccagcttcgcgccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggactcgggggcggcagcggcgggcgcctggggagccgcggtgtgctcagcagccgcggcaggaattaggggacatgctcgttaattgtttccactatcagccgccgtctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgcacggtttccacctgacggagccacgtcacgtcggccacaagggccccgtgctgggcgctgggttcggttcccggccgtcctcttgtggccgccttggcgttcattttatgacaccttgccggtgttcccagacatcatcccgcaccgctccgttttaccgacctccaggtcttcccgcccctgatcagaccccaacagcaaccgtactatatctggaccctatatttgaactacgtggtgagaatctgtgaaagcgagcctctcaggga

SEQ ID NO: 126240 - DNA, 37 bp, Homo sapiens; identical to SEQ ID NO: 95971
  chr6:88982725-88982762
  Hypo

SEQ ID NO: 126241 - DNA, 49 bp, Homo sapiens; identical to SEQ ID NO: 95972
  chr6:89792319-89792368
  Hyper

SEQ ID NO: 126242 - DNA, 48 bp, Homo sapiens; identical to SEQ ID NO: 95973
  chr6:89827453-89827501
  Hyper

SEQ ID NO: 126243 - DNA, 48 bp, Homo sapiens; identical to SEQ ID NO: 95974
  chr6:89827745-89827793
  Hyper

SEQ ID NO: 126244 - DNA, 120 bp, Homo sapiens; identical to SEQ ID NO: 95975
  chr6:89849217-89849337
  Hypo

SEQ ID NO: 126245 - DNA, 20 bp, Homo sapiens
  chr6:89849397-89849417
  Hypo
gcccgcgtggcagagcaaga

SEQ ID NO: 126246 - DNA, 85 bp, Homo sapiens; identical to SEQ ID NO: 95977
  chr6:89857318-89857403
  Hypo

SEQ ID NO: 126247 - DNA, 120 bp, Homo sapiens; identical to SEQ ID NO: 95978
  chr6:89857583-89857703
  Hypo

SEQ ID NO: 126248 - DNA, 417 bp, Homo sapiens; identical to SEQ ID NO: 95979
  chr6:90120876-90121293
  Hyper

SEQ ID NO: 126249 - DNA, 87 bp, Homo sapiens; identical to SEQ ID NO: 95980
  chr6:90121597-90121684
  Hyper

SEQ ID NO: 126250 - DNA, 30 bp, Homo sapiens; identical to SEQ ID NO: 95981
  chr6:90122393-90122423
  Hyper

SEQ ID NO: 126251 - DNA, 826 bp, Homo sapiens; identical to SEQ ID NO: 95982
  chr6:90142902-90143728
  Hyper

SEQ ID NO: 126252 - DNA, 30 bp, Homo sapiens; identical to SEQ ID NO: 95983
  chr6:90349357-90349387
  Hypo

SEQ ID NO: 126253 - DNA, 239 bp, Homo sapiens; identical to SEQ ID NO: 95984
  chr6:90367251-90367490
  Hypo

SEQ ID NO: 126254 - DNA, 30 bp, Homo sapiens; identical to SEQ ID NO: 95985
  chr6:90596072-90596102
  Hypo

SEQ ID NO: 126255 - DNA, 94 bp, Homo sapiens; identical to SEQ ID NO: 95986
  chr6:90644578-90644672
  Hypo

SEQ ID NO: 126256 - DNA, 185 bp, Homo sapiens; identical to SEQ ID NO: 40861
  chr6:90661223-90661408
  Hypo

SEQ ID NO: 126257 - DNA, 30 bp, Homo sapiens; identical to SEQ ID NO: 95988
  chr6:90995490-90995520
  Hyper

SEQ ID NO: 126258 - DNA, 941 bp, Homo sapiens
  chr6:91004761-91005702
  Hyper
tgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgcc

SEQ ID NO: 126259 - DNA, 1010 bp, Homo sapiens; identical to SEQ ID NO: 30644
  chr6:91320285-91321295
  Hyper

SEQ ID NO: 126260 - DNA, 1006 bp, Homo sapiens
  chr6:94126125-94127131
  Hyper
gtgaaataaacattgcgagattactgtttattgccattctgctacccctcagctcagcctgggggtggaagcaagggacctaagcagacagcagtgatggccaagttaagagagaaacaaactaacaaattaaaacaaaacagaacccggcccgagaacgtttaatcggaagccgctctcaagtgatccgtgcgtctctcttctgctcggtccgctctctggttaaaccctcaaaagagcgcgtatcccttcccgctcggagcagagtgccgacctccctttgcgcccgcggaggcgcagtccctcggctcacccggacgctgggggccaggcctaggactccagggctccgcgccccggagtcctgtgggccaacaggtgatgggagaggggctagactgggggcgcgccctgacagacccaggcaacgaccgcgcgggcaaaggctggcgtcccggggctggggcggggccgtcggaggggcggggcgggggctgccagacgggcgcgccagccgcgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaagggggtttcttatcttcctctagccacccccaaatgccccaggaggcccggcacctgcttcaagcggttcccagcgctagcccttgggtactgcgggccgcctcggggcttgtgaactcctagaacgccagctcttggtcgccgctgcgccctagaggcgtcgccgcctagaagccgggcgcactcgccgcccgccagccacagatc

SEQ ID NO: 126261 - DNA, 580 bp, Homo sapiens; identical to SEQ ID NO: 95997
  chr6:94127417-94127997
  Hyper

SEQ ID NO: 126262 - DNA, 477 bp, Homo sapiens; identical to SEQ ID NO: 95998
  chr6:94128430-94128907
  Hyper

SEQ ID NO: 126263 - DNA, 717 bp, Homo sapiens
  chr6:94129167-94129884
  Hyper
ccccttctcggtccccgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggccaaggggcgggtcccggcgaaatggccgccccggccacgggggcggggtccgaggcaggagccaatcggtgccgagcggagtcaggttgctggtccaggattccctccaggttctgagctcgcgctggatgttcagaggagaacgaggatggtagccgaggtgtgtgctgctttggacgctctgcttttagcaaccgcagctttcgcgtagcagaataaatccgagaataacgctcccaacttacactcttttctatagctgtactccgcgcgatcttttagaaaccagaggcgaagcaagccttctctcagctaccaagcacggagcccggacagtgaaatgagctgtgcctttaagtaaagtgtgttttacttttttgttgttagaacctccgcgggctgggtaactttgttttttgcctttttgaaaagtttctacttctctttttctgttactccaagagccgtcagttttaggta

SEQ ID NO: 126264 - DNA, 691 bp, Homo sapiens; identical to SEQ ID NO: 96001
  chr6:96463169-96463860
  Hyper

SEQ ID NO: 126265 - DNA, 122 bp, Homo sapiens; identical to SEQ ID NO: 30653
  chr6:96464082-96464204
  Hyper

SEQ ID NO: 126266 - DNA, 38 bp, Homo sapiens; identical to SEQ ID NO: 96003
  chr6:96464457-96464495
  Hyper

SEQ ID NO: 126267 - DNA, 38 bp, Homo sapiens; identical to SEQ ID NO: 96004
  chr6:97285806-97285844
  Hyper

SEQ ID NO: 126268 - DNA, 24 bp, Homo sapiens
  chr6:97299307-97299331
  Hypo
gtgagactccgtctcaaaaaaaaa

SEQ ID NO: 126269 - DNA, 30 bp, Homo sapiens; identical to SEQ ID NO: 96006
  chr6:99164434-99164464
  Hyper

SEQ ID NO: 126270 - DNA, 1176 bp, Homo sapiens; identical to SEQ ID NO: 96007
  chr6:99271691-99272867
  Hyper

SEQ ID NO: 126271 - DNA, 30 bp, Homo sapiens; identical to SEQ ID NO: 96008
  chr6:99273084-99273114
  Hyper

SEQ ID NO: 126272 - DNA, 280 bp, Homo sapiens; identical to SEQ ID NO: 96009
  chr6:99273322-99273602
  Hyper

SEQ ID NO: 126273 - DNA, 53 bp, Homo sapiens; identical to SEQ ID NO: 30658
  chr6:99273848-99273901
  Hyper

SEQ ID NO: 126274 - DNA, 93 bp, Homo sapiens; identical to SEQ ID NO: 96011
  chr6:99275537-99275630
  Hyper

SEQ ID NO: 126275 - DNA, 167 bp, Homo sapiens; identical to SEQ ID NO: 96012
  chr6:99275841-99276008
  Hyper

SEQ ID NO: 126276 - DNA, 50 bp, Homo sapiens; identical to SEQ ID NO: 96013
  chr6:99276380-99276430
  Hyper

SEQ ID NO: 126277 - DNA, 77 bp, Homo sapiens; identical to SEQ ID NO: 96014
  chr6:99276704-99276781
  Hyper

SEQ ID NO: 126278 - DNA, 21 bp, Homo sapiens
  chr6:99277180-99277201
  Hyper
tagggggagaaaatgcgagcg

SEQ ID NO: 126279 - DNA, 141 bp, Homo sapiens; identical to SEQ ID NO: 30662
  chr6:99277261-99277402
  Hyper

SEQ ID NO: 126280 - DNA, 201 bp, Homo sapiens; identical to SEQ ID NO: 30663
  chr6:99278897-99279098
  Hyper

SEQ ID NO: 126281 - DNA, 2142 bp, Homo sapiens
  chr6:99279350-99281492
  Hyper
agaatggcaggcagacgcgcggactctgccctgacagggtcagcccaaagaatgggccccagagcccggggcgggggaggaaccggtggagaggccccagtctggacctaaaaccagcgagagctcaggtttcgggagccccgaagaggtgccgcgctgggaggcagacaaggaagcccagggtgctcggaacccggcgttcgcgccaaccgggcccctggcgcctggaggggaggcggcggtagctcgtggggaggtgttgctcagagccgcggtgcgagcccagcctggcccgcccggtgattggccgcgcttgggggtgggggtggggtgcagagactgaggccccgggtaggctatttctttgtgtactcccggggatttattgggtatattaaaccctgttgggaacgtttcggctccttggccgccagcgaaatgagacggggatggaagttggagttgagacctgggaagtcaacgtgggaaggatctcagcattaatcgccggtgatgtcctatcgcagacaggaagttttgatgtacacgtgcagcctattcttgtcccctcacactagcgccctatgccgggaggagggcgggggtgtggggtggggtgtggagagaaagataagaggaggaggaacttttaaattgattcagagccaggccgcctcagttccttcgaagatgtgtttgaaaacttcattcttctttcgagtgtatcatcctatgggctgcagaaggccttgtgcctcgagaaatgtgaaattaaatccagagaaaagcagacacctgccccagaaaggtgggggagaagtatgagctgcttagcacttggacgcggcccttccccagggctggattcttctgtccgtgggagctctgagctccaggtccgcgaaaagaaaggcacgacatgtcaggagaagatgcggctggcgggctgtctgtgcgctccccaaggcccagggaaagtcacgcgcctagcacaggggacgcagggccgaagccgggagaaggcggttctgcccgccacccagccccttggctcgcggttgcggagccgcgggcaccagtcgctgagtctgcgcgctgaggctcggacttgttcattttttcctagctagacaaagttatgggattcctagcagcccccaggcgcgcggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcagccaaagcgtcttgcccgggcgggtgctcaacgtggtgatttataaacagctcagccactctccaaagagcatgactccttgttagtcatgatgaattttctggcccgctccagtctgctgtctggattcagatgctcagaggccccaaaatgctccctctgagcgttgatttggctgccctctcaagcctacgaccgccggcaaaaccagcgatagagcgaggggtgagaggtggggacgcgatccaggttccctggggtctgtcattcccttcccggcagtaactgttgattcgctttacagcgcccatgtacacacccggccctgcgtggcggtcacgccgctccagcctgggtccgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggccgcacacccctcgcc

SEQ ID NO: 126282 - DNA, 207 bp, Homo sapiens; identical to SEQ ID NO: 96021
  chr6:99281846-99282053
  Hyper

SEQ ID NO: 126283 - DNA, 41 bp, Homo sapiens; identical to SEQ ID NO: 96022
  chr6:99282531-99282572
  Hyper

SEQ ID NO: 126284 - DNA, 302 bp, Homo sapiens; identical to SEQ ID NO: 96023
  chr6:99282778-99283080
  Hyper

SEQ ID NO: 126285 - DNA, 702 bp, Homo sapiens; identical to SEQ ID NO: 96024
  chr6:99283339-99284041
  Hyper

SEQ ID NO: 126286 - DNA, 30 bp, Homo sapiens; identical to SEQ ID NO: 30673
  chr6:99284652-99284682
  Hyper

SEQ ID NO: 126287 - DNA, 375 bp, Homo sapiens
  chr6:99290280-99290655
  Hyper
gggcgagtgtgctgccggccaacatctgctccttgcccagtcgcaaaagaggtaccttggccttgccgcgcaccccccacctcggggaccctggccgctgtcgcgaaggcccagacagcctagctcggccgcgcggggaggagagagacagggaaaggagcggggcactccctgcactcccagccccggccttcgctcgggacgctgccaacagcccctgagttcctgcctggaaatcagggattctctgcggctccccaggcttcgacgcccggacccccaggggaagggtcaacagctcggacgtcgagctgttccactctatcgcttcccaaggaagcgggctaggggtaacgggcacggttggtgggtttg

SEQ ID NO: 126288 - DNA, 650 bp, Homo sapiens
  chr6:99291285-99291935
  Hyper
accctctgggcaccccggcatctcaagccagagctgagggcccggaaagtgaggggccgcgcctcagtactggaggcctagagtccatctccgcgaactgggggctctcagggcccgcagaaatcccccttagccctccgaggcccctggaaggagtcgccccgggagaggaaatcactcagctctgaaaagcgtcgcaaacgggcggtgggagagttctaaagcggcctttcgcctctcggaggaggtgaggccgagctggggatgtgcgggtttggggcccagaactgcaccgcagggccgcagaggcgggaagctggccggagaggagtgggaaggcgaccaagggcagcagcaggggctcctgcggggcgcaggtctgtgctggcgccgggcctggcctctgcaggctcggcggagcctcccgattgctcccgccgcacccgcccgcggccactcacccggccccgcggccagcccgggcggggtcgcacgcaaacaaggatgcttctatttactcgcctctgcctgtagatttctaagacattcagcaggcacaatcattaaactaatttgtgtttgattgtttgggcggacggagggtagttttattgcgctaagcattcaagcaggcacgcatcgctgattac

SEQ ID NO: 126289 - DNA, 318 bp, Homo sapiens; identical to SEQ ID NO: 96030
  chr6:99292203-99292521
  Hyper

SEQ ID NO: 126290 - DNA, 30 bp, Homo sapiens; identical to SEQ ID NO: 96031
  chr6:99293257-99293287
  Hyper

SEQ ID NO: 126291 - DNA, 875 bp, Homo sapiens
  chr6:99295649-99296524
  Hyper
tccacacacgcctcccgtctagagagccccagtggcccagggccacctccagtccctggacttggaaatcaggacgctgtggatcccacaggcgccccgcgacatcctggagtcgccgggagtggcgctgcggtgaaagccggtgcctagagtgggcttaggggtcccattccactcggaaagtcctctcacctccccaagggccattctgccggcgcaatgtgggggtccctccgccactcgagcagagcctgcctaggccaggcacccctttgggtgagagcggagggcccctgggacgcccagccaggcctggcgtctggggagccggggctcctgtgtgtgtcgggcaggctccgatggccgaagcagggacgaaggaacggcttcgctgcgggaggctagagggctgcgcttccgccctcccggcctccctcttgccgcatgagcagcgcagggcctcctgggctgtgctggggtcaagagttatgaacacttcgtgtcctcaggagctcacgggggtgacgagaggcggtctgggtctgaagccgctacacagaggggagcagtggggcctcggggagcagcggggcctcggcttggcggctccccccgccaccccgccacctttcaggacccaggccaagccgcctcacgaagaccaggaagcggcctctgccgggaagccacctgcagcctatagtcccctccccaagcggccccagcccgtgctatctcctacatagttgccttccgaacgcctggagggccctgacccttccggtgttccaccgcaatggggtcggggggagaggggggctgtggctgcctgagacctccagggcagcgcacattacgggcgggaaagggaagtc

SEQ ID NO: 126292 - DNA, 149 bp, Homo sapiens; identical to SEQ ID NO: 40863
  chr6:99396329-99396478
  Hypo

SEQ ID NO: 126293 - DNA, 29 bp, Homo sapiens
  chr6:99396718-99396747
  Hypo
tgagccaccgcgcccgcccttggcacttt

SEQ ID NO: 126294 - DNA, 30 bp, Homo sapiens; identical to SEQ ID NO: 96037
  chr6:99797154-99797184
  Hyper

SEQ ID NO: 126295 - DNA, 30 bp, Homo sapiens; identical to SEQ ID NO: 96038
  chr6:99961087-99961117
  Hypo

SEQ ID NO: 126296 - DNA, 70 bp, Homo sapiens; identical to SEQ ID NO: 94446
  chr6:100036662-100036732
  Hyper

SEQ ID NO: 126297 - DNA, 201 bp, Homo sapiens; identical to SEQ ID NO: 94447
  chr6:100036959-100037160
  Hyper

SEQ ID NO: 126298 - DNA, 834 bp, Homo sapiens
  chr6:100038640-100039474
  Hyper
tgccttccttcccctcgtcgccttcctcccactgtgcgagcttcggaaccctaaggccggttcactgcgcattgtccccgacaagttagcagcgctccccgaggggtgtgaggcaccaggtagggtgcagggcgcgagcgcggggcggtggtgcccggcgggggtggggtgcccacggacgcagccgcctagctctgccggccgtcctgaggcagctgctggcgcccgccgggaggcgcgtggccacttgcacttcagcgcgcggttctctctccgcaggctgctttctaggatttgaaagggccatagcgacagaagtcgatctctaagaaggcataaactcggcctgagacgtgggggggagacactgcagagaagaggccaagttccagcgcagaaggggggttccgcggggccctgggattgaggagacaggagcgagccttccctttccgtcctctcaggaaaacagcctgacctgctggcacgtccacccccaacagaagagggaccccggcgcggcgtccttaccatccccatcccccgacccctgaggaagccagggctctcttctttccctgggcgcctgtcacaggggcagaggctgggcctcgagcttttctgcacgtgagctcggtggtccagcagagtcttctggctcccgggaaagcagcgtggcgccgccccagcccccagtccccagactagggattgggacgtcagtcattggctgcaggttactggtctgggctgggcccgcagagatcccaagcgctcctctgtcggtgcttcctcagcgtctgcgtttccgcagatgcccgaggtcagacagtt

SEQ ID NO: 126299 - DNA, 184 bp, Homo sapiens
  chr6:100050341-100050525
  Hyper
agaacacctttatttcgccttttaactctccgcctttctgattaaagagttcagacctgctccccggcccgcgttcaattattccccagcatcttttctcagaagctgtcaccaccacttgcggaaccgcagcctcatcgtgagccattagcccagttgtttcccgtttcgcttttctttcctc

SEQ ID NO: 126300 - DNA, 1397 bp, Homo sapiens
  chr6:100050754-100052151
  Hyper
aacagcaaggaaaatcgaattgagtgcgggctcattcggcagcggccggcagagaagcgctgaatgtggaggtgccccgagacattgcaattcagcaacacgctcgctgacttttctttgcaccatgtcaaccgaaagaaccaagaaataagttggagaactccggttaaaaggcaacttgagagggattctgaatacttttattgagccgtttccaacggaggacttaaaaaacaacaaaaaaggcaccacaaaacccaccagcggcgtccgggctgcgtcctggctgccactttggagcctcccggccgccgcgcatccaccggccatgcaattaaggggaaaatggcctcatcgccggcgtgtcatctggtggcgttcccagagcccatcgccgccgccctattcagacccggccttaatgtcccacccgcgcctcgggggccgcgcagctggtccaagctgacccgcccgcccggccagcgcggacaccctcggggggtgcagcccaggccacctcaggccaaaattcggctactgaaagcggggcttgcaggactctctctgctttccctaacctccttcgcctcgggtctctgaccccgcgcggctctctgcatccccgggttcaggactcctccggccccagttttgggattccgcgttgacctaggagggaggggtgtttggtgagtcaccagcaccagggtctccaaggctgagcccgcctccccaacccccgggacaactccctcggtccccgtggggacctgaaactcaaggcctttgagcgacggtgacgagcagccccggagaagtgtggtctgaaagaagccgctcatctcagcctcaaagtcttaaggggctcctttcctctaggcggagccgagtcaggtcacacgtgctcggcgccggccgcattcccagctcttcgctcattcgcgactatgcgccaggcggggccgccccctaacgctgccgggttcgaaagccgcccgcgggtgggacttagctctccgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacgcccatttcaagtcgataaaaaaaaaaaaaaagccgagtggaatgttttgattgagtctcaacattgtctttgaataaggctgagaccatgtaattaatgtgtctttttaataagggacaatacggccgttcaagctatttaatttcatttaattttccatcccatttgctgcacagcccgcttttacttttaa

SEQ ID NO: 126301 - DNA, 293 bp, Homo sapiens; identical to SEQ ID NO: 94457
  chr6:100052449-100052742
  Hyper

SEQ ID NO: 126302 - DNA, 222 bp, Homo sapiens; identical to SEQ ID NO: 30693
  chr6:100053289-100053511
  Hyper

SEQ ID NO: 126303 - DNA, 992 bp, Homo sapiens
  chr6:100054839-100055831
  Hyper
tccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgccattcgcctctcagtgccctgacccgggaaaggggtacgagagaaagtggaggaagggagtgattgagtcgttacctgctaattctgccgggtggaaggggactcctattattctgagcaagtagcctctttaactgtgagagctggacggggtcgggctgagaggagaggatgtggccgagaggcgacagccctgggtggggtgcactgagcgctgtaggtgccgggaccattcgcagcttgtgttttcccctgcgctctcgggtctcctcagtcagaagccagaagcccacccccgcacgctgtccgcagctctctctgcaaaagcaccctctttctgggggctcagggcatcgagaccctttcttcccttctgcccttcaatatgttaatttgaggcctaatttcgccttaaagtaattttttttcctgaaaaaaaaaatctttgggaggctctcagttcctagaacctcctcagatatttttttttcccttgccgatgtcggcttgtgggtatgcggcatatggagagaggatgagcaaggtactggctctgacgcgggctccaagggcgaggcgcgcccattcgcgcggggcacagggtcagagcgtctgcagcggggctctgagagtccagaggcccaaccgggaggcgccagggccaaaccactagctttgactcccacactccacacaccgtcgcgacccctgaccagagagacttatagcactcgcccgctttggggg

SEQ ID NO: 126304 - DNA, 2113 bp, Homo sapiens
  chr6:100060975-100063088
  Hyper
cctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 126305 - DNA, 819 bp, Homo sapiens
  chr6:100066608-100067427
  Hyper
tgagccgcgttactccgagcgctcccattggtgcattccttggagccagggttgctattggtggcgagctggccgcggcgaaagaaccccggccgcttgggctagtgcggcggcggccaggcggagccggaggtgagagtgcgagcagcgtcctgtggcgtggcgacccctgggctcacagcctcgcgctccctgggctcacagcctcgggctccctggactcacagcctcgccctccctgggctcacagcctcgcgctccctgggctcacagcctcgcgctccctgggaataggggtttctggggtcttgttggggcagaggtgcgggagtctcgccgcgtttaggtggacagtccaggagtcctgctggagaggaggacctgggaagacccgcgatgccggcaggaggacgggagagtttcaggcgtaactggtctttgtggaaaccgcccgaccccgctgtggaggggagctgcggcacccgcgccgtgcgctctcgccatctgccgccttcccaacgggaagagggcagaggcgccggcgccatcgcgaggtcaagcgtgacccttggccacccaggtgtgagttgtgaagaggaggactcatcagacggctgggccaacgtgtttagttccagaaggagcgtggcgctcgctctgggctcggcgacctccctacaaaagatgaaaggagggcttctgtcatatgcgactgtagtttaattcaaattaagccgttgtaccacagacaacttgttaatgcctttagcttgcaaaccctccaagagtccttcaaaaagggaccgaaagtgggtggac

SEQ ID NO: 126306 - DNA, 874 bp, Homo sapiens
  chr6:100441291-100442165
  Hyper
aaggccgtccggaggcgcgtacaggggacacggggatctacctggaggaagaactgaatttgtcttttctagttcaaaaaagccttcccgaactcttagcaaacaagccagtgatcgcctcctcgccttcgccacttcagttcagcctctttagtccccatggagagccgggatgaactagcccggcgcgctccagcggtctcggtcggggccgctgcttcccggaaagccactccctttttcttttcccacctgtgtttccattttctttgccgagtgtgaaaccagccggccacccacccgccccgctccgtctcgtaggtgcctccacagagccaaactttgtaccttctggggatggagggggatcccccagcaatcagacactaccggcgagccagccccggggaggggcgactggtggaccaggcgccagaccttcccgggcgcgcagcccacgggccctggggcgcgcccacgccagagcccggccctcgcgcggcagcccgcgggacgtcacctgggtgctcgcgtcctccccgcgcggcggacagcccgggcgcccttcctctctgcgggactgcaggtctatccgctaagcgcgcgtgaccaaaaacggctctcagcgggtcccagctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcgggtgcgtcgtgctcttttctaggagcgtggggtgccttcgcgaataaaatctgaaggcatctctgctctcgcggagcttgttcttt

SEQ ID NO: 126307 - DNA, 353 bp, Homo sapiens; identical to SEQ ID NO: 94470
  chr6:100729492-100729845
  Hyper

SEQ ID NO: 126308 - DNA, 29 bp, Homo sapiens
  chr6:100902455-100902484
  Hyper
ttttgtaatattttcgttctcatctctaa

SEQ ID NO: 126309 - DNA, 1228 bp, Homo sapiens
  chr6:100903253-100904481
  Hyper
ggggtcctcctggaccgttctggaagggcccccgccacagccacctgtacacaccccttggccttatcacatttatcgctcttcccctttcagccaacctattctccttcgtttctgtcacgacctgctcttctctttctaaatcccggctccgacatacccactcagaaggagtgacaggagggattggctgcggaggccacacgggggaaaggagaaaggaccctattgggaaagccgaggacgccggcgacgctggcccttgggcgctctggggcctacggaggccttaaaccccaaagattggcggggacgaagggccggggcactcgagcgagcctggagcgggcaaagactgcgttgcgactggggacaggtctcgcgcggttcccgaagggtgcgaagactgcgctgagcattttgaaggcctcccaaagcggctggaagacaccccgaagcggcctcccaaccagaatgatctgaaaatcccccaggctgggctcgggataaatactagttctgaactcccggcgccagcctaggccatttgttgtttcgggtttcggcctcattagtatgcgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgagggggtaagctgagatttcgtttctgcacttgacctaccgcagaaaattcgcaaatcctttgattgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaaaggattttcctcagctaaagtggccgaagacaaaggaaa

SEQ ID NO: 126310 - DNA, 41 bp, Homo sapiens; identical to SEQ ID NO: 94474
  chr6:100905267-100905308
  Hyper

SEQ ID NO: 126311 - DNA, 92 bp, Homo sapiens; identical to SEQ ID NO: 94475
  chr6:100905783-100905875
  Hyper

SEQ ID NO: 126312 - DNA, 391 bp, Homo sapiens
  chr6:100905935-100906326
  Hyper
ctctctctctctgccttcgcggagctccagccctcgagtttgggcttcccgtagggatagagcctgcgggccaacctggctgcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactccgggtcttcgaatgcggcccagctttggctatgccacctccctagaggcccgcgctggcgaggccgagcccgaacgcgcgggcgaatcccacttaggttctacttggcgcagggactcggacgatggcacctaacccgccttcccgggaactgcccaaa

SEQ ID NO: 126313 - DNA, 1234 bp, Homo sapiens
  chr6:100911997-100913231
  Hyper
ctcacccatgccagccgcatcctccagacccctgggaagttgcccaaacaacaaaatacatatttctgaagacccgcaagggatcttccgccgcggatccccgagtccgcgcccaggccgggcgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcggcctctcccacaccaccgcggagctgcggggctgctgggcgggcgcggggcgtcttctgcttcacctaccttcagtccccacaagcggcagaggtttcgggggcgcccatctcttaactgttctcatgcctaccgtccaacccagcgacaccgccggcctctccgcttcccaccggcagagaggagcagagcattcccggctcccttttctggatcatgaattggaggaggggtgcgtggcagaaagaggaggatgcaagctttgggacgagtgaggtgattttagaatcctggtcctccgtagttgctacgaagccagttcactattattcctaattggaagccgaaaactgccccccgtaacttctttatagcttaagggtttagcttcaacttcactccggggccgcctctctcccgccctccctcaatgccactcacaagccccctcgcctcccattggcctggcgcggccaggggcgaggcgctcattggccaatagggctgagtgacacgagtcggccccgagccgccctccgcgcgcccaggctccgggctctgaatcttactacccgcgggaccgctggactcctaatgagctcagggtgccgggtcggcgctgtccggttgccgccgctgctcgcggcctcctgggccttcccgacgtcgtgcgcgacccgcgctcctcgagctccctggggtcgggtggttgagcgctcagtccagcgcggcggcccagcagaaccgggaacgtccggaggcagcggaggtcgggcctgcgggttaggtctaccggcggaggaggcagggt

SEQ ID NO: 126314 - DNA, 30 bp, Homo sapiens; identical to SEQ ID NO: 94480
  chr6:100913748-100913778
  Hyper

SEQ ID NO: 126315 - DNA, 958 bp, Homo sapiens
  chr6:100914823-100915781
  Hyper
gtaaggaagtcttcacgcttaaggctgacgtcctggggggctgggcgggctgttccaatgtcccagtgaagctcagttgtcaatgagccaagtagatgtcgtttaataaacaaagtgaatgcacgaccacgaggtgacggcctctcgctaagtcctcagcacacaactgtctgagccgcgtttaccgagagagtgaattagcatgacgacgtaacacctgtttttctaatctttgaacctaggttggagccggaacgctgctccttcactccccctcccgggcccagggacctggctttgcaccctccccacgaccccgcctgccagccccccacgcgccctgtagccggaggcgtgaaccgtgaaccggaacctcaggtgcctcccacgtgttctgcgaatttacgttcgcctctagcacgggaaattttaaatgaatttcttgaagctcagagactaatcgttttgccaatataaggagaaaagccccagaaaggaagagacggtcacgggcgacccactaaccccaaatagagatccttatagagtctaggccgccacctccttgagccggtggccttaaaacctagcctctggccctcaggcacccagaatgcgatcctgatgtgggagaaaacccatgcggggctgcaaaaaagtgtctccctccttcccccaccaagcagggcgaacagcctagtgtgatggcgacactgttcccccaagagtccctgccacttctggggcaacccaggatgctgccctcatggagcctgccccggaccccggaggccaggacatgcaggcgtccgtgactctaccccaggggagccaggccgggtagattctggaaccaacgcgcctttgtgagcaatgtctagcatgccgcgcgcacccagaaagaagggggagcgggcacctcaagggccttctgacccctccccgcaaaaggcaaaat

SEQ ID NO: 126316 - DNA, 191 bp, Homo sapiens
  chr6:100917195-100917386
  Hyper
aatccctgtccgaatcgggaattggcattccgtaagggagcggagggcctcaggccactaggcagctccgaacgcggggaagcgggagcaaagatgagctcagagcgagggttgccggcgccaccctgggctgcgcagtgaggggccgtggacccgccccgagactcagtgacagtcgcagcttaaccccg

SEQ ID NO: 126317 - DNA, 1433 bp, Homo sapiens; identical to SEQ ID NO: 94486
  chr6:101840541-101841974
  Hyper

SEQ ID NO: 126318 - DNA, 304 bp, Homo sapiens
  chr6:101847302-101847606
  Hyper
ccgctcccaggcagccggatgtaaacaggcggttcgctctgcctggcggtgggctccgtggattctgatctgctcactgctctgtcgtctcctggggcttttaaagaactccttgtgctttcatttcttctcttctttatttttatttttagccgcgggagggtgaagggagggccaatgtgtggtagtggtctctgcattacctccccacagtagcttgccacggagatgatgatgacgatggaggcacggtcagccgccactcccgcctgtctcccccggcgccctgcgagcttggaggggt

SEQ ID NO: 126319 - DNA, 272 bp, Homo sapiens; identical to SEQ ID NO: 94487
  chr6:101849938-101850210
  Hyper

SEQ ID NO: 126320 - DNA, 326 bp, Homo sapiens
  chr6:101850475-101850801
  Hyper
tcttggttgtcaccccgcctttgatcctgtgttgggacaacttgggttttcctgggtgcccacccggcgggcaaggtgcattttagagagtcagttctcctgccctaggtcgagccagatgttctctggccggcttttctgggagcagagcctgcgactctcccaggcaggcgtctccagagcgctggcgcggcgggcacagggcatccagcgcgtcccagcgtatgtaaatgaggcatctttgtttcgccgcagctgcgtcccggccttgcccgccccaggatagggtgaaggcgggactcttccgtccgcgggggtgtgaccaa

SEQ ID NO: 126321 - DNA, 31 bp, Homo sapiens; identical to SEQ ID NO: 94489
  chr6:103355599-103355630
  Hypo

SEQ ID NO: 126322 - DNA, 91 bp, Homo sapiens; identical to SEQ ID NO: 94490
  chr6:103355690-103355781
  Hypo

SEQ ID NO: 126323 - DNA, 19 bp, Homo sapiens
  chr6:105143888-105143907
  Hypo
ccaccgtgcctggccctcc

SEQ ID NO: 126324 - DNA, 40 bp, Homo sapiens; identical to SEQ ID NO: 94523
  chr6:105384637-105384677
  Hypo

SEQ ID NO: 126325 - DNA, 80 bp, Homo sapiens
  chr6:105388314-105388394
  Hyper
gcggcagcggccgtgcgcgcccacggcctgcgcggggacgcgcttcgggggttcgggggcgcccgcggtaaagctccacc

SEQ ID NO: 126326 - DNA, 1078 bp, Homo sapiens
  chr6:105388632-105389710
  Hyper
ggcgacagcggattccgtgcccggtggccgcgcgccgcccggctgttccgcgtccccttgccggctcacaatgtgctgaccctcccggccccgccgcgcgcctcacaggtctctcgacctccgcgctccctcaggaagtgacagactccaggccccttcctccgccccgtccttcgggactgaacgccacacacgtcctcacaccctctccccctctcacacccaggctagcgacgcgaccatgaggccccggaggtaagcagccggccccgcggccgcgcgagtgcgagcgtggccgggtgtgcgtgcgggtgcggacgccgctcgcggtcccgagtctggcacgtgagcaacgtcgaggggagctccgtgctgaggagcaggaagaaaagaggaggcgcgagcgccagggaggggcgaggactgggcaccgcggggaagtgacaggtctcgcagcaagttgcggttcggaagccggcgcgccgcgtctttccttcgccggccctgatttattgccccggtgctgccgctaagacgcgggcagtcgatgtacttccgggttcacacctttctctccccgctcggtgctgctgggtcggcgcccggtgtgggcactgcgttgccacagcggccgcccaggctcgccgctgcggttgctgccgggcggccaaagccggcttggagcgggagggcggggcggggcagggcgggggcgcaggccacgcgggggcgcagggcgcgagggtgcggcgcaggctggggtcccggcggcgggtcctcgcggccggtgccggctcgtctgggacgcacggggccgcgccgccagagggcgtgcgcacctccctttcgcgctccgcaagccgaactgctttgtaccgggcaggcgtcggggatcgtttttgctttggtatcggtgatgtaaattcatgaattaaaattaaggattttgaaaagaacggggaagaacgcacttggatttaggttgtttttgaaaaggaaaaaccaaagaggaaatgatacgtttgcaggagcattaactgactactgactggaacattggatgcgggtgctttgtgaa

SEQ ID NO: 126327 - DNA, 30 bp, Homo sapiens; identical to SEQ ID NO: 94527
  chr6:105389920-105389950
  Hyper

SEQ ID NO: 126328 - DNA, 362 bp, Homo sapiens; identical to SEQ ID NO: 94528
  chr6:105400890-105401252
  Hyper

SEQ ID NO: 126329 - DNA, 234 bp, Homo sapiens; identical to SEQ ID NO: 30722
  chr6:105401581-105401815
  Hyper

SEQ ID NO: 126330 - DNA, 35 bp, Homo sapiens; identical to SEQ ID NO: 94530
  chr6:105404005-105404040
  Hyper

SEQ ID NO: 126331 - DNA, 155 bp, Homo sapiens; identical to SEQ ID NO: 30723
  chr6:105404519-105404674
  Hyper

SEQ ID NO: 126332 - DNA, 268 bp, Homo sapiens; identical to SEQ ID NO: 94532
  chr6:105404877-105405145
  Hyper

SEQ ID NO: 126333 - DNA, 895 bp, Homo sapiens; identical to SEQ ID NO: 94533
  chr6:105405570-105406465
  Hyper

SEQ ID NO: 126334 - DNA, 1557 bp, Homo sapiens
  chr6:105584077-105585634
  Hyper
tgctaagagtcttttcgcacttattcatgcttcaaagcaggcagtttctgggacttgtctggccaacaacccgttcccaaaggctcggggaaggaggttgcgggtgggtggcgcggacctcgggtccccagccatcggcgctctcccggggccctctgacctcgctccttaaaggaggagggtccgtggcaacggtcctcctcggccaggcgctctcgggacgcgggggtgaggagtgagcgccgtggcccaccctactctccgagcggggacggagtgggcgacaccgcgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggtggggccgagggcccggggacgctggggctgcctgacctgagcggcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagagggggaagaggccgcgcgggagggacttctgacacgcgccactgtttttgt

SEQ ID NO: 126335 - DNA, 715 bp, Homo sapiens; identical to SEQ ID NO: 94539
  chr6:105627368-105628083
  Hyper

SEQ ID NO: 126336 - DNA, 257 bp, Homo sapiens; identical to SEQ ID NO: 94540
  chr6:105750389-105750646
  Hypo

SEQ ID NO: 126337 - DNA, 42 bp, Homo sapiens; identical to SEQ ID NO: 94543
  chr6:106114044-106114086
  Hypo

SEQ ID NO: 126338 - DNA, 621 bp, Homo sapiens
  chr6:106429003-106429624
  Hyper
aaactgctatgaattcggtgactgtgcaatgaaattgtcaattatcctctctgccttcctgcgttgaaagagtttcaagaagttgtggtgagtggatgtattcccagacggatgcgggcggtccccgggcagggaccccgaatccggggtcgcagggtggtagagccggaagattggattccatctccgcaaggattgagaaaaacggactcaccgactgaactattccatctccaagttgtttttattttccactttaagcataagaacgatgagaaccaggagccaggcggccccgcgtagcggtgggagcgcaggtacccgagagtaccctctgggggccggcccggcgcgctcgctcctcctcgcctttccgggaaccgtgcgcaggagctcacacggcacgcctgcggccaggggcaatcgggttctcggttcccggagtcccagttcccggtttccagtttccttatcgacgcgattgttccgtcggggtcttccaaggggatccgaatggtggccaagtcccgctggggaaatccgcaggggtgcggcctgcggggcctttgggggcgcacctacgccacgggctctgccattcctatccggaaaattcaagct

SEQ ID NO: 126339 - DNA, 177 bp, Homo sapiens
  chr6:106434102-106434279
  Hyper
gacgagctctgaggccgaagatgcgttgcgtgactatgctgctgcctggacgcggggtctctagtccggaggcacggaaggacctgcctgcctgactctagtctgcaagtctcgggcacacgcgcggcttctgcccacccgcgtaaatgccctggggaaaggcgccctttcttttat

SEQ ID NO: 126340 - DNA, 1307 bp, Homo sapiens; identical to SEQ ID NO: 30734
  chr6:106441813-106443120
  Hyper

SEQ ID NO: 126341 - DNA, 30 bp, Homo sapiens; identical to SEQ ID NO: 94548
  chr6:106534045-106534075
  Hyper

SEQ ID NO: 126342 - DNA, 329 bp, Homo sapiens; identical to SEQ ID NO: 94550
  chr6:106808855-106809184
  Hyper

SEQ ID NO: 126343 - DNA, 97 bp, Homo sapiens; identical to SEQ ID NO: 30736
  chr6:106958240-106958337
  Hyper

SEQ ID NO: 126344 - DNA, 87 bp, Homo sapiens; identical to SEQ ID NO: 94552
  chr6:106959519-106959606
  Hyper

SEQ ID NO: 126345 - DNA, 107 bp, Homo sapiens; identical to SEQ ID NO: 94553
  chr6:106959939-106960046
  Hyper

SEQ ID NO: 126346 - DNA, 715 bp, Homo sapiens; identical to SEQ ID NO: 94554
  chr6:106960308-106961023
  Hyper

SEQ ID NO: 126347 - DNA, 44 bp, Homo sapiens; identical to SEQ ID NO: 40866
  chr6:107075561-107075605
  Hypo

SEQ ID NO: 126348 - DNA, 332 bp, Homo sapiens; identical to SEQ ID NO: 94557
  chr6:107809976-107810308
  Hyper

SEQ ID NO: 126349 - DNA, 43 bp, Homo sapiens; identical to SEQ ID NO: 94558
  chr6:107810622-107810665
  Hyper

SEQ ID NO: 126350 - DNA, 126 bp, Homo sapiens; identical to SEQ ID NO: 94559
  chr6:107812382-107812508
  Hyper

SEQ ID NO: 126351 - DNA, 165 bp, Homo sapiens; identical to SEQ ID NO: 94560
  chr6:107886594-107886759
  Hypo

SEQ ID NO: 126352 - DNA, 75 bp, Homo sapiens
  chr6:107955933-107956008
  Hyper
gccccccgggccccccgggcgcgggcggccagctcggcttcccaggcgtgctgcagggcccgcaggacggcgtca

SEQ ID NO: 126353 - DNA, 88 bp, Homo sapiens; identical to SEQ ID NO: 94561
  chr6:108274499-108274587
  Hypo

SEQ ID NO: 126354 - DNA, 80 bp, Homo sapiens; identical to SEQ ID NO: 94562
  chr6:108280340-108280420
  Hypo

SEQ ID NO: 126355 - DNA, 179 bp, Homo sapiens; identical to SEQ ID NO: 94563
  chr6:108323266-108323445
  Hypo

SEQ ID NO: 126356 - DNA, 324 bp, Homo sapiens; identical to SEQ ID NO: 94564
  chr6:108434925-108435249
  Hyper

SEQ ID NO: 126357 - DNA, 795 bp, Homo sapiens; identical to SEQ ID NO: 94565
  chr6:108436034-108436829
  Hyper

SEQ ID NO: 126358 - DNA, 470 bp, Homo sapiens
  chr6:108438107-108438577
  Hyper
cactcccgccctctacgacgtcctccctggcccgggcagcccaactggggcggggacgggggttactcgggtcggatccccttttcttccctatctatcctacctccactcccgcggccacgcgaaggcgtctcacccacccccttaggggcacgtgggcgaatgtctggtggccgggtgagtggaacccgccgcccagtccttgcagcgggctctggtctagtgggtgaggatccctggggaggtcccaactccggtgcagcgtccgcggggtgaagggcgcgagtgcattcaggccccaagggaaactcggggacatctgcacagacaagaatccccaaggaggcccaggtcccacggccaaagtcctcgacccccaccaggctgtctccctctagtcctccccactcctgacctgccattcgggacggagccagtccgcgggcacccaagggcgcaagctggtacaa

SEQ ID NO: 126359 - DNA, 139 bp, Homo sapiens
  chr6:108438779-108438918
  Hyper
catgtgatgtgtgagcggtgtgtgatgtgcgtgtggtgcgaagaggggaggtgacaggccagagaggtttccccaaagggagaggcacggagggcttccggagtgagggtgcctgggggtgaggcgggagctgggcact

SEQ ID NO: 126360 - DNA, 1664 bp, Homo sapiens
  chr6:108439495-108441159
  Hyper
gtagcagaaaggaatcgaggcccccgtccataatcgcaggtgtcggcgtggaaaggagccacgcgtgcacactcatgggtctcaccgcgcgggcttccgcggcccggcaagccgctgcgcctgcctcgccggcggcccacggagcccgtccgcgcttgccctgcacacctgcgcccgcgcgaggacccagccgccgaggccgtgcgcccgccgggctgcgggggccgtgggcagggggcgcagggggcgcagggggcggccggcgcggcggctgaacccgggctgacgaggcccagccgcctgcggggcccggagcgggaggtaccggctaggggcgcgtttctttcgcatccacaccccgcccccacccctctctccagggattttttttttttttttttttgtatccaggcacagctgggggctccctcaccacccacccctggcctccccatacagaataaagtcagtctgtatttaatggttatggcggatgtgagggggatttggcagaggcagaagagaggcctttcgctctcaaatatcgtcccttacgtcgtgtgagtctaccaacccaccacgacctcatattcttgtgcgggtgtctgactcgaatgacaagcgagctgattttttcagtacatagctgggaaatgtagtgagtgataatagagatttctctttcattttttacgcttgacttggttattgttgcttttcttttcccgtgattccttctgaggattagctctgacttccccactattggcggtcaaagtggccccgactcgggatgacaattgacggggatcaagggattgcccattctgtgcctgtaagaaccgattcgtgccagagaaactcatcaagtggaggcggagaataaagaccgttcgggggtaaatgtattcattgagaagggttctcccaaattgcttctaagtttttttaatgaaaagtaacgattgcggcaatcagcggctttttggcggattacaaatctggagggagctgcggcgctgcattgaaaagtgcccccgccttcgcaccgggcagccggttcacaggagcagcgcgaggggcgggggtccgatagcgggacaaaggcggggagggggcgagcggaggagggcggctcggggcgcccgggcgcgcatcgggcaggagacgcggaggtgcccaccccagcgcaggcgtggcagggcgccccccaccgaggaaggcgtggggcagggtgcaggaaggggaccgagggaggtctaccgcagcaccaccagcactggggagattccgggcatctggagcgaggaaggtgtgctataggggttgagtccatcaccgtggaagtccggggaatgggaggtgcgactcggtcccccacctctaccccgggcacggtggtgtcttcttttaaagacgtctcacttcgcaattggaatcgaagcgtgggccggtgtcgggtcttcctggtgttacaggcaggaggagggaaaactgagtccttcctgggatggggcaggaccctcacacgcaagaccccactgagctggactggcgcgggggcggatcccttctcccaaatgcttctgaatggcgcgcgacctggtcccctctgccacacggaccctgcgcgcacgccctggccctggcggcctctggggaca

SEQ ID NO: 126361 - DNA, 21 bp, Homo sapiens
  chr6:108475755-108475776
  Hypo
ttccatctggccaggcgcggt

SEQ ID NO: 126362 - DNA, 30 bp, Homo sapiens; identical to SEQ ID NO: 94572
  chr6:108478521-108478551
  Hyper

SEQ ID NO: 126363 - DNA, 890 bp, Homo sapiens; identical to SEQ ID NO: 30747
  chr6:108478806-108479696
  Hyper

SEQ ID NO: 126364 - DNA, 324 bp, Homo sapiens; identical to SEQ ID NO: 94574
  chr6:108484872-108485196
  Hyper

SEQ ID NO: 126365 - DNA, 1969 bp, Homo sapiens
  chr6:108485513-108487482
  Hyper
aaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctctctgggcgccgagttcgagaaagcgctacgccgccggtcgggctagctccacaagcggctgtacaagttggctgtcaaaaaacgctgatttctcctcctgtcacctaataaacccctacgcgcttatggcctcgtcccacaatcccccaatctcgtcccaattcgaaaaaccgaggaggagggaataaactgagagataaagatccccccatcttgctctttccccgggaccccagccttggtcgcggcgccccactaaggaggacacaggctctggtgtgtgtggtgtgcgagaccccgagctcgaggccgagccaaggctgggcagaaagttgcaatcacgtgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggggtaggggatgagggcctctcttcactattcctccgcccggagagcgggagcccgcaacgcccgccgaggacgagcggcgggagggaacgctctgccctccagccgccccggtgcagataatggaggcgacaagagattcgctcagcgtcggatgggccagctctgcttggggaagctggcggcatcctcccctcggctggtgcccaaacccactgcgcgaaggccgaaggaacgcggaacctccagaagaccccatcctcagccctgactttccgtagatatgtgcaaaatgagtaaattactcacctcgggccagatccaagttttacccaacagaaggggcaccggaccaagaatgaaccaactcacatggccatgtccggcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcaccgtcctcaccatcacgcacgcacagagccacactcccatattcacactttctaactcgtaagctccgacagcgcctgcattttctttgggagccgcttggaggttcattaatatcattagcatttaaccccctccctcttcccatcccctccccgcacatggctgacgtcagaccccgccaggagttgggggaaaagctaagtgggccagggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttcct

SEQ ID NO: 126366 - DNA, 1222 bp, Homo sapiens
  chr6:108487779-108489001
  Hyper
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactggggaatttaaagtatggcgaaccactctagcaaagagaggaccaaatccctaatcccaaggacttttcgagccggagcccagcagaggcaggagtgcgcggcctgctccctccgtgcgcttctctccttcctcgaacttccttagctgccggctctccgaacgccaggccgcagctgacctctcaccaccccgagactcacgagcgcagggctaagtgtgtgtgcgagggcatttgcttgcaccctgcctgcggaacccaagaatgtgcaggcccgagccagcgttgagcaggcgcggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttcc

SEQ ID NO: 126367 - DNA, 2116 bp, Homo sapiens
  chr6:108489330-108491446
  Hyper
gcctaccctggccctcgctgttggaatctccaggaggtaaagcgacctcgatttttgttgcccgcattcccgggcgtgagtgtccttcccaggaggctcaggaggccgtttctgttgcattctgagcctccgttgcaaaaactgaagcccgtgggtctcggcaggcctcctagctcgctcgccccgggacaggccctcgcctacacccctggaagtaaggagccccgggctctttcgtccttttcggggtgtggagcccctggggcccttgaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcagccaacccgagacttgcgtccctcgggcccggggcagctaggaggtcggcgcgcagcgggccgggtcaggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggctcgcctcacgtcggagctcgctcggcttgctaaatgagaggagctttgcaacggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtccggaagctcgggcgggggaatccgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagccggtggccgccgcgccgcgcgcctcccctgcccgcctttgtcgccgtccgaattcccatgctactctttttgacgggtcactggtggctctataggcaggtgctgccgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcgaatttcagggaggcctgaggccgctggggcccaaac

SEQ ID NO: 126368 - DNA, 346 bp, Homo sapiens; identical to SEQ ID NO: 94585
  chr6:108492203-108492549
  Hyper

SEQ ID NO: 126369 - DNA, 1270 bp, Homo sapiens
  chr6:108495639-108496909
  Hyper
tctctggggccaagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtccgggactggccctcttgaagtagcctgggacgtcccagccccttctcgatctggccctgctcatgcccaaggccctcgcgttttgcaggcccaggctcggggctccagggcctgcggccgggcaaggtcgcgcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctgggaattggcctcgggctttcagtcgtatccttcccgtctttcagcaggagccgctggcgacccctagaattccccagggcaagacccatgcccacatcaggaacttgcgccccacagtcatctccacacaggcagcgcttggggggaccccactctccaggggaccggcgcgcattttctgcctccggtcctaatccctctttgcagcccttcgtggccacccttaagcctgctagcctgccccaggatcttaaaatctggatagtctcacggggaggagatcatacaggctggaagttcgcggtgtgttgaaaaagggagggcagagacgcgaaaacgcggaatttccagcccgtgtgcaaattctccaagatgccaaaatcagtacggccattgggccgatgtgagtccagggccttctctctgttctacagaaaagagggaaagggggctggagaggcagggtaacgcccgtgggtgcctcggacacccagctctcccaaggctcttaagcgcgcaacagcaagaaccaggacgtcagagtgcttcctgggcctggagcacggtccgagctgcgtcccccgctgcagcctgtcgagggcgccccaggcccaggcagggggcgagggtaatgggctggaggacaccgtggggcctgggaa

SEQ ID NO: 126370 - DNA, 837 bp, Homo sapiens
  chr6:108497125-108497962
  Hyper
tttctccagcatactcggagacgggttctccctcgttccattccctagcaatcccggggctcgggtcctttcctcctgcggccctcggaggccaaaagctatttctgtgggggcggggcctgcgggtagggaggcttgttcttggacggagctggaaaagtctgcgcagaaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatcgtggcactttgagcacgggcccctcttctaagcctcagcttccgaatctattcagtgtagtggttagacgatctcagaatcccttcctccctcagattccctctcccttcttcttttcacctcttgggcgattttgcccgcccagacttgacattggggcggggctggggggagagccgcagcggctgtgtctcgacgtctctaatcgccggcatgcgtttctctgtttgcctctgcagccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaaggtcagcggccttgctgggcc

SEQ ID NO: 126371 - DNA, 131 bp, Homo sapiens; identical to SEQ ID NO: 94595
  chr6:109038572-109038703
  Hypo

SEQ ID NO: 126372 - DNA, 24 bp, Homo sapiens
  chr6:109057736-109057760
  Hypo
tgttaggaatattctcggcccggt

SEQ ID NO: 126373 - DNA, 82 bp, Homo sapiens; identical to SEQ ID NO: 14879
  chr6:109059835-109059917
  Hypo

SEQ ID NO: 126374 - DNA, 39 bp, Homo sapiens; identical to SEQ ID NO: 94598
  chr6:109578459-109578498
  Hypo

SEQ ID NO: 126375 - DNA, 139 bp, Homo sapiens; identical to SEQ ID NO: 94599
  chr6:110299095-110299234
  Hyper

SEQ ID NO: 126376 - DNA, 193 bp, Homo sapiens; identical to SEQ ID NO: 94600
  chr6:110299501-110299694
  Hyper

SEQ ID NO: 126377 - DNA, 30 bp, Homo sapiens; identical to SEQ ID NO: 30765
  chr6:110299948-110299978
  Hyper

SEQ ID NO: 126378 - DNA, 869 bp, Homo sapiens
  chr6:110678874-110679743
  Hyper
cttcttcacgggatgcgcggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggccgaacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggccctctccgcccctccggaggtgccagggcccggctgtacagggtc

SEQ ID NO: 126379 - DNA, 454 bp, Homo sapiens
  chr6:110797490-110797944
  Hyper
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagacccctcggcgccgcctcccgcgtggcgccgcggggcccctcccccatacctgccgaagtgccccacgtggtcataaatcccctcgaagtggcgggaccccatggtgcggccgtgcactgggcgccgagttagccgagctccggggactgcgggtagcgcgccccgccccgaacctccccgcccggcctcctgctctccccgcgcgtcccagtgctcgggaccagcgcgaggctgtattctgttcctccctccgtcgcttggcccctcgg

SEQ ID NO: 126380 - DNA, 52 bp, Homo sapiens; identical to SEQ ID NO: 94608
  chr6:111409316-111409368
  Hyper

SEQ ID NO: 126381 - DNA, 217 bp, Homo sapiens; identical to SEQ ID NO: 30769
  chr6:111409641-111409858
  Hyper

SEQ ID NO: 126382 - DNA, 16 bp, Homo sapiens
  chr6:111581391-111581407
  Hypo
gcgtgagccacggcgc

SEQ ID NO: 126383 - DNA, 30 bp, Homo sapiens; identical to SEQ ID NO: 94611
  chr6:111874444-111874474
  Hypo

SEQ ID NO: 126384 - DNA, 53 bp, Homo sapiens; identical to SEQ ID NO: 94613
  chr6:114177562-114177615
  Hyper

SEQ ID NO: 126385 - DNA, 872 bp, Homo sapiens; identical to SEQ ID NO: 94614
  chr6:114663003-114663875
  Hyper

SEQ ID NO: 126386 - DNA, 268 bp, Homo sapiens; identical to SEQ ID NO: 94615
  chr6:114664337-114664605
  Hyper

SEQ ID NO: 126387 - DNA, 137 bp, Homo sapiens; identical to SEQ ID NO: 40872
  chr6:116574057-116574194
  Hypo

SEQ ID NO: 126388 - DNA, 61 bp, Homo sapiens; identical to SEQ ID NO: 94617
  chr6:116783506-116783567
  Hyper

SEQ ID NO: 126389 - DNA, 158 bp, Homo sapiens; identical to SEQ ID NO: 94618
  chr6:116937904-116938062
  Hyper

SEQ ID NO: 126390 - DNA, 30 bp, Homo sapiens; identical to SEQ ID NO: 94619
  chr6:117001154-117001184
  Hypo

SEQ ID NO: 126391 - DNA, 668 bp, Homo sapiens
  chr6:117086196-117086864
  Hyper
tgttggcactgcggccgctttcgctcctaggtggccgcggtcggaaggtgggtcaccccgcacccttgcggccggggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgcgccctcaagccgactcccgggccggcccctcgctgccctcccgcaacctcctccctcccaggacctccccgtcggagccctggctcaccgtgaccttggggcccagaattgctgggggccccgccgctggagtagcaggggagaccccggggcggaagagccggtgcgggccgtcgcgtggcctcgagaggcgccccggggccgcagcggactgttagcccgcggccaaggcgcagtaggctcccgaccgccctgagcatgctgcccgcttgtcccgcgccgcacccgcacctccggacccagccacaggcgttgtccccgcagctctcctcgtcccgccccggcctgccgcgcgctggagagcctgggacgtgcagctggaacc

SEQ ID NO: 126392 - DNA, 21 bp, Homo sapiens
  chr6:117089618-117089639
  Hypo
ccaccacgcctagccagcaca

SEQ ID NO: 126393 - DNA, 74 bp, Homo sapiens; identical to SEQ ID NO: 94623
  chr6:117197631-117197705
  Hyper

SEQ ID NO: 126394 - DNA, 169 bp, Homo sapiens
  chr6:117198137-117198306
  Hyper
tgtgggcgcccagggcgtgacaggcgcaggtgagaaagtgagtttcgcgggagcatctgccgggaccgcagacaggtggagaaacgcagtcccaccgcggcccaccgcggctcccgggcggcctgggctgtacctgtgcgcggcgtcctttctgcgctgagccagggca

SEQ ID NO: 126395 - DNA, 30 bp, Homo sapiens; identical to SEQ ID NO: 30778
  chr6:117198544-117198574
  Hyper

SEQ ID NO: 126396 - DNA, 849 bp, Homo sapiens
  chr6:117585846-117586695
  Hyper
aactttaaaggaccccggccaaggagaccccagcatgaaaagccagacatccgaggccgggtaaagcctcctggactcctcgaaagcagctcacaccgggagcagccggaagcgggcgcgatctatgcgaagctaacgggttccggtggagaacatcaaagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggtacccggactcccacatcctgtctgccacgacccggactccctaggggattccaagggacagcaccgtcctccccatacatcatcaggaaccgaaagcagagaatttgccccacctcggcacttctggaagcacccactcaactacagtatgagacaagggctttcctaagagacctttctccaactttctttctctgcgtgtatgagcccggatcccttcgtccccgcctccttctctctctctctttctctctctctcctattttgtcctgggagattcctactcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcccgctccgcagcccccgagtggcgtcagcacgcccgccgggcatgggcttta

SEQ ID NO: 126397 - DNA, 167 bp, Homo sapiens; identical to SEQ ID NO: 94627
  chr6:117587123-117587290
  Hyper

SEQ ID NO: 126398 - DNA, 101 bp, Homo sapiens; identical to SEQ ID NO: 94628
  chr6:117587547-117587648
  Hyper

SEQ ID NO: 126399 - DNA, 1071 bp, Homo sapiens
  chr6:117591136-117592207
  Hyper
gacttcaaaatatgtcgatggactttcagtctgtcagagacgttaggtggtggggggcacattttctggagcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttgcagcccccttagaaaaacgccgctgcagaggcgggggctgcccatcagccccggccatggctagccagccctgtgcccgcccggcgccttcgtctctcgggcgggacgtgcaggtcggcgctgagtccagccgcagtgacacgcacctcttttcctttcctccactccgcctccccggccggcctacagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtct

SEQ ID NO: 126400 - DNA, 20 bp, Homo sapiens
  chr6:117913241-117913261
  Hypo
gcacaaggctgggcacggtg

SEQ ID NO: 126401 - DNA, 30 bp, Homo sapiens; identical to SEQ ID NO: 40873
  chr6:118113403-118113433
  Hypo

SEQ ID NO: 126402 - DNA, 1855 bp, Homo sapiens
  chr6:118227995-118229850
  Hyper
ccaggccaattatggcgaatgtagtaggagcaacatctaggattctccgtttgggtttctaatccggggccggcacctgtctcggcgtcctgccgctgtcccaggccggtggtgctggattccgcggcgcttgggcagaaacgaggaatccccgccaactccacagggaggatctattcccagcccccttatccccctaaaaaacacccaaaccaaaacaatcaccacaacctagaccgtgggcctctgcggacggggcagtagagggtcgggggcaacaaggcacctcggcagcgccctctggcgagaggagagcgcgcaggtcccccgcccgcgccccgctctgccgccgccgccgccgccgccgccgccgccgccggcgcccccgcccggctctccgggttcaccctcggtctctcactccgtgagacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcctttgggacggggttgcggccggaggagactgaggagatcgggcgacgacgcgctccgcgggcgcagagaggccgcggcagctttgtcccggcgcagggagccctggagtggtggagctgcagctggtccgaggcgggagttcggggagaggcggggtttttcgtacctagccaccctgtatgtgtgtccgcactcacaccctccatacgcgtgccgcctcacttccctttccctctcgcaccccggctttgcgatcgggggtcggggggacgcggggacccggccagggctgaggagggaggcgcggggctgcagagatggcgtggaagtcctgggcctcgtgctgtcctccgccccgccccgcccgggggcttcgaccccttgccgggggaatggggtcgcagcgacagcctagcaggcggagggaacccacttctccagcctgacgctccagtcgcctctcggactcttcctggctgggagcagcgaagagagggctagaggcctggaacagacccagcaaagtgcaaaacattgcgggcagggtgtgagccggcggcgcccagttattccgaagcgcccatgccggagggggcgggtgccgatcgccggcgcctccagtgctggaatctgcgtagtggattcaggacgttgacgttttaggatgaggacctgggttgacgtgaaaatgggggt

SEQ ID NO: 126403 - DNA, 521 bp, Homo sapiens
  chr6:118241005-118241526
  Hyper
tcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtggagctctttgtgacgccgggttcccggggctggctggagtctctgtacctatctggatcctgctgcaggccggggaaacactgcgctcttagagaggggccctgtcctccacagatagccccgcagaccctcggaacgcgggtggacggggagggcgtgcgcgagcctcggggcttgggtggtggctggaaaagggagaaccaggaggcgggggaggggcgctcggactacagaggaccggacgggggcgagtgttccgcggggtgtgtggagtaagagctgggacggacctttgtagct

SEQ ID NO: 126404 - DNA, 143 bp, Homo sapiens; identical to SEQ ID NO: 94641
  chr6:118971559-118971702
  Hyper

SEQ ID NO: 126405 - DNA, 152 bp, Homo sapiens; identical to SEQ ID NO: 94642
  chr6:119030526-119030678
  Hyper

SEQ ID NO: 126406 - DNA, 30 bp, Homo sapiens; identical to SEQ ID NO: 40874
  chr6:119240714-119240744
  Hypo

SEQ ID NO: 126407 - DNA, 30 bp, Homo sapiens; identical to SEQ ID NO: 40875
  chr6:119254223-119254253
  Hypo

SEQ ID NO: 126408 - DNA, 149 bp, Homo sapiens; identical to SEQ ID NO: 94645
  chr6:119254660-119254809
  Hypo

SEQ ID NO: 126409 - DNA, 543 bp, Homo sapiens; identical to SEQ ID NO: 94646
  chr6:119399076-119399619
  Hyper

SEQ ID NO: 126410 - DNA, 36 bp, Homo sapiens; identical to SEQ ID NO: 94647
  chr6:119510906-119510942
  Hypo

SEQ ID NO: 126411 - DNA, 157 bp, Homo sapiens; identical to SEQ ID NO: 94648
  chr6:119527110-119527267
  Hypo

SEQ ID NO: 126412 - DNA, 45 bp, Homo sapiens; identical to SEQ ID NO: 94649
  chr6:119538695-119538740
  Hypo

SEQ ID NO: 126413 - DNA, 20 bp, Homo sapiens
  chr6:119560062-119560082
  Hypo
ttattatttttgagacggag

SEQ ID NO: 126414 - DNA, 32 bp, Homo sapiens; identical to SEQ ID NO: 94651
  chr6:119584473-119584505
  Hypo

SEQ ID NO: 126415 - DNA, 147 bp, Homo sapiens; identical to SEQ ID NO: 94652
  chr6:119590025-119590172
  Hypo

SEQ ID NO: 126416 - DNA, 151 bp, Homo sapiens; identical to SEQ ID NO: 94653
  chr6:119604968-119605119
  Hypo

SEQ ID NO: 126417 - DNA, 42 bp, Homo sapiens; identical to SEQ ID NO: 40878
  chr6:119689647-119689689
  Hypo

SEQ ID NO: 126418 - DNA, 30 bp, Homo sapiens; identical to SEQ ID NO: 94655
  chr6:119714970-119715000
  Hypo

SEQ ID NO: 126419 - DNA, 30 bp, Homo sapiens; identical to SEQ ID NO: 40879
  chr6:119824210-119824240
  Hypo

SEQ ID NO: 126420 - DNA, 30 bp, Homo sapiens; identical to SEQ ID NO: 94657
  chr6:119849249-119849279
  Hypo

SEQ ID NO: 126421 - DNA, 280 bp, Homo sapiens; identical to SEQ ID NO: 94658
  chr6:119888178-119888458
  Hypo

SEQ ID NO: 126422 - DNA, 45 bp, Homo sapiens; identical to SEQ ID NO: 94659
  chr6:119958265-119958310
  Hypo

SEQ ID NO: 126423 - DNA, 30 bp, Homo sapiens; identical to SEQ ID NO: 40882
  chr6:119989053-119989083
  Hypo

SEQ ID NO: 126424 - DNA, 30 bp, Homo sapiens; identical to SEQ ID NO: 94661
  chr6:121193323-121193353
  Hypo

SEQ ID NO: 126425 - DNA, 29 bp, Homo sapiens
  chr6:121370472-121370501
  Hypo
tgctggccagatcccgcaataataaataa

SEQ ID NO: 126426 - DNA, 30 bp, Homo sapiens; identical to SEQ ID NO: 94663
  chr6:121654694-121654724
  Hypo

SEQ ID NO: 126427 - DNA, 57 bp, Homo sapiens; identical to SEQ ID NO: 94664
  chr6:121758249-121758306
  Hyper

SEQ ID NO: 126428 - DNA, 417 bp, Homo sapiens; identical to SEQ ID NO: 94665
  chr6:121758539-121758956
  Hyper

SEQ ID NO: 126429 - DNA, 30 bp, Homo sapiens; identical to SEQ ID NO: 94667
  chr6:122021822-122021852
  Hypo

SEQ ID NO: 126430 - DNA, 36 bp, Homo sapiens; identical to SEQ ID NO: 94671
  chr6:122931170-122931206
  Hyper

SEQ ID NO: 126431 - DNA, 411 bp, Homo sapiens; identical to SEQ ID NO: 94672
  chr6:122932059-122932470
  Hyper

SEQ ID NO: 126432 - DNA, 1020 bp, Homo sapiens
  chr6:123316893-123317913
  Hyper
tcatataagttcctccggaggcttaatcatcagtacattgtcttggaaccactctggtgttttctaaattaaatatctctgtctacaacaaatgcgaaaagtacagaatgtttccgtactccttctacatcaaaattgcctcctacaggaacgagaaaatgcgtgtcaatgtgaattaccgtctacaacagctactctccaggctgatctggggtcttgcacacaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctggtaggagcggctgctctttctt

SEQ ID NO: 126433 - DNA, 30 bp, Homo sapiens; identical to SEQ ID NO: 94676
  chr6:124012649-124012679
  Hypo

SEQ ID NO: 126434 - DNA, 793 bp, Homo sapiens; identical to SEQ ID NO: 94677
  chr6:124124293-124125086
  Hyper

SEQ ID NO: 126435 - DNA, 79 bp, Homo sapiens; identical to SEQ ID NO: 94678
  chr6:124734409-124734488
  Hypo

SEQ ID NO: 126436 - DNA, 30 bp, Homo sapiens; identical to SEQ ID NO: 94679
  chr6:125013668-125013698
  Hypo

SEQ ID NO: 126437 - DNA, 77 bp, Homo sapiens; identical to SEQ ID NO: 40885
  chr6:125081173-125081250
  Hypo

SEQ ID NO: 126438 - DNA, 20 bp, Homo sapiens
  chr6:125088325-125088345
  Hypo
caccgcgcccggccctattt

SEQ ID NO: 126439 - DNA, 61 bp, Homo sapiens; identical to SEQ ID NO: 30799
  chr6:125282732-125282793
  Hyper

SEQ ID NO: 126440 - DNA, 1172 bp, Homo sapiens
  chr6:125283133-125284305
  Hyper
gggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggccgggccaggctccccacgcgccgcagcctcggagcacgggctccccggaggggacttggggcgtcccagcccaggaggaaggacccggaagcagaagcggagccgcgagtcgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttcccc

SEQ ID NO: 126441 - DNA, 39 bp, Homo sapiens; identical to SEQ ID NO: 94685
  chr6:125286425-125286464
  Hypo

SEQ ID NO: 126442 - DNA, 162 bp, Homo sapiens; identical to SEQ ID NO: 94686
  chr6:125397724-125397886
  Hypo

SEQ ID NO: 126443 - DNA, 366 bp, Homo sapiens; identical to SEQ ID NO: 94687
  chr6:125420809-125421175
  Hyper

SEQ ID NO: 126444 - DNA, 241 bp, Homo sapiens; identical to SEQ ID NO: 94688
  chr6:125474789-125475030
  Hyper

SEQ ID NO: 126445 - DNA, 174 bp, Homo sapiens
  chr6:125475547-125475721
  Hyper
agggagtgagaggatcgcccgccgagggggtggctccgcagcccggctgcgcgagacgcttcccgctcggggacccgccttccgaggccaggtgaacgttaccggccccctgacctccagcagatccacacgtgagtcccggtttccgcgatcggggagcgacctctgcctccc

SEQ ID NO: 126446 - DNA, 168 bp, Homo sapiens; identical to SEQ ID NO: 30804
  chr6:125684529-125684697
  Hyper

SEQ ID NO: 126447 - DNA, 29 bp, Homo sapiens
  chr6:125737982-125738011
  Hypo
atcctctcagccaggcgcagtggctcaca

SEQ ID NO: 126448 - DNA, 245 bp, Homo sapiens
  chr6:126068007-126068252
  Hyper
ctaagccttccctttcgctgaaaaggttgtcgcagaagggcggggaggcttgaaatcccgccgttccctcattctttctcttttctttctctccacataacgcctcccctacacctccccacctccaatccactaccgtatttaagtcggcgggggcgctttaaagggtttcctgtgtctgtttctgtctctctgacccgaaacgcactttcggttatagacagacaaggcgctcaaccaaggga

SEQ ID NO: 126449 - DNA, 1162 bp, Homo sapiens; identical to SEQ ID NO: 94694
  chr6:126068780-126069942
  Hyper

SEQ ID NO: 126450 - DNA, 30 bp, Homo sapiens; identical to SEQ ID NO: 94695
  chr6:126070219-126070249
  Hyper

SEQ ID NO: 126451 - DNA, 148 bp, Homo sapiens; identical to SEQ ID NO: 94696
  chr6:126071185-126071333
  Hyper

SEQ ID NO: 126452 - DNA, 193 bp, Homo sapiens; identical to SEQ ID NO: 94697
  chr6:126235500-126235693
  Hypo

SEQ ID NO: 126453 - DNA, 30 bp, Homo sapiens; identical to SEQ ID NO: 94699
  chr6:126274515-126274545
  Hypo

SEQ ID NO: 126454 - DNA, 337 bp, Homo sapiens
  chr6:127439190-127439527
  Hyper
gaaggtcaggaaagccgggaacaagtcagcagccagaaactctccagcgatctgccaagggggagagggtagttgcgcgccggcgctggggatggggtgggggcgctggggcacaagggcgcaggggcgcacggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtc

SEQ ID NO: 126455 - DNA, 2555 bp, Homo sapiens
  chr6:127439783-127442338
  Hyper
cctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagccggctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatccccgacacgcaccagcggagccaaagggcgcgcgaggcgatggggttcgcgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagatggaaatttagtaatcgcttctcggccgctgtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactccccacccactctttcattccggcccggacgcggaaggggaggcctggggttcagcggtgtccacgcgcctggcggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccacacacttgtcaaggagggacagggtactgagtgtcagaggcgtctcgctttgcagttttg

SEQ ID NO: 126456 - DNA, 50 bp, Homo sapiens; identical to SEQ ID NO: 30816
  chr6:127442649-127442699
  Hyper

SEQ ID NO: 126457 - DNA, 213 bp, Homo sapiens; identical to SEQ ID NO: 94712
  chr6:127836013-127836226
  Hyper

SEQ ID NO: 126458 - DNA, 1084 bp, Homo sapiens; identical to SEQ ID NO: 94713
  chr6:127836665-127837749
  Hyper

SEQ ID NO: 126459 - DNA, 972 bp, Homo sapiens
  chr6:127839721-127840693
  Hyper
acttctcagcagaggcgaggtttccaagtagctgaacaaatcaacagcactttccttctgatattccggggatctcagggtttattattgtgcctttctgcgccgaggaaagttcaacttcatattattgtatgcgactttccggctgagcatgactttgggctcgctcgccgcagttccacacccactcgatttctccaaacaatggcggtaacgtcaagattcagctgcccccagagcgggtgacttcccggcggtccgcggctgggctggagctgcagctctcagcaggctaacacgcgaggtaccaagctgggccagacgctccccaggaagtgcagagatgttcatgagctgacctcaccgaactgggcaggagagaaggcgggattgcaagggacgatagggtagaagtaaccaaagagaggttactttcaagaggaaagagaagaaggcggggagggggacgggggacgggggtggggagtggcgggataaagagacaaaaaggccagagccacgcccgagatggaagattggcagcagcgctcaaactccttgctctattctcttatcccgtacttggcagaggatcccaaaaccgctcgaacacggatgcactggtttcctgcaaagctttgtcctgggttcggtcattctccatcaattatttacttgagcttcttttccaaggaggcggactagaacagccttccgggcgtgactaacatctcctgatgcagctggctggcggctgctgggagttctctttgttcactcactttaattctcagtcgagctctacacgcggtgctccctccccacccccagcccgggcggagtcatcagatgtcgtttccacgaatagataatggttgccatgatgggacccaccgtcccacagacaaagggttcttgcgaagccacgactaatttagtgcaaaccgaaataaatatcggcccacagagatc

SEQ ID NO: 126460 - DNA, 48 bp, Homo sapiens; identical to SEQ ID NO: 94716
  chr6:128840325-128840373
  Hyper

SEQ ID NO: 126461 - DNA, 64 bp, Homo sapiens; identical to SEQ ID NO: 94717
  chr6:128841037-128841101
  Hyper

SEQ ID NO: 126462 - DNA, 142 bp, Homo sapiens; identical to SEQ ID NO: 94718
  chr6:128841577-128841719
  Hyper

SEQ ID NO: 126463 - DNA, 390 bp, Homo sapiens; identical to SEQ ID NO: 94719
  chr6:128901705-128902095
  Hypo

SEQ ID NO: 126464 - DNA, 399 bp, Homo sapiens
  chr6:129204289-129204688
  Hyper
ccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtaggggga

SEQ ID NO: 126465 - DNA, 57 bp, Homo sapiens; identical to SEQ ID NO: 94722
  chr6:129480603-129480660
  Hypo

SEQ ID NO: 126466 - DNA, 30 bp, Homo sapiens; identical to SEQ ID NO: 94723
  chr6:129958014-129958044
  Hypo

SEQ ID NO: 126467 - DNA, 248 bp, Homo sapiens; identical to SEQ ID NO: 94724
  chr6:130088218-130088466
  Hyper

SEQ ID NO: 126468 - DNA, 30 bp, Homo sapiens; identical to SEQ ID NO: 40889
  chr6:130182604-130182634
  Hypo

SEQ ID NO: 126469 - DNA, 30 bp, Homo sapiens; identical to SEQ ID NO: 40890
  chr6:130241934-130241964
  Hypo

SEQ ID NO: 126470 - DNA, 114 bp, Homo sapiens; identical to SEQ ID NO: 94728
  chr6:130339570-130339684
  Hyper

SEQ ID NO: 126471 - DNA, 30 bp, Homo sapiens; identical to SEQ ID NO: 94730
  chr6:130465678-130465708
  Hypo

SEQ ID NO: 126472 - DNA, 39 bp, Homo sapiens; identical to SEQ ID NO: 94731
  chr6:130499389-130499428
  Hypo

SEQ ID NO: 126473 - DNA, 149 bp, Homo sapiens; identical to SEQ ID NO: 40891
  chr6:130530028-130530177
  Hypo

SEQ ID NO: 126474 - DNA, 30 bp, Homo sapiens; identical to SEQ ID NO: 94733
  chr6:130608796-130608826
  Hypo

SEQ ID NO: 126475 - DNA, 1541 bp, Homo sapiens
  chr6:130686377-130687918
  Hyper
gtaacctgaacctctcgttggctttgatgtttggagtcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccagagttaggtaaacgctgtctctcctaaagtttgggaaataaaccaagtccgccatcaggtccagactccccagtcccgggagcgcgagagaagccgtgcggggcagcctccaagaacccggagtactggagcg

SEQ ID NO: 126476 - DNA, 30 bp, Homo sapiens; identical to SEQ ID NO: 40892
  chr6:130808098-130808128
  Hypo

SEQ ID NO: 126477 - DNA, 30 bp, Homo sapiens; identical to SEQ ID NO: 94740
  chr6:131269546-131269576
  Hypo

SEQ ID NO: 126478 - DNA, 18 bp, Homo sapiens
  chr6:131389805-131389823
  Hypo
cctcgggaggctgaggca

SEQ ID NO: 126479 - DNA, 69 bp, Homo sapiens; identical to SEQ ID NO: 94745
  chr6:131455780-131455849
  Hypo

SEQ ID NO: 126480 - DNA, 21 bp, Homo sapiens
  chr6:131532615-131532636
  Hypo
tgtaatccagatgggcgcggt

SEQ ID NO: 126481 - DNA, 181 bp, Homo sapiens; identical to SEQ ID NO: 94747
  chr6:131602777-131602958
  Hyper

SEQ ID NO: 126482 - DNA, 89 bp, Homo sapiens; identical to SEQ ID NO: 94748
  chr6:131616389-131616478
  Hypo

SEQ ID NO: 126483 - DNA, 41 bp, Homo sapiens; identical to SEQ ID NO: 94752
  chr6:131884134-131884175
  Hypo

SEQ ID NO: 126484 - DNA, 86 bp, Homo sapiens; identical to SEQ ID NO: 94753
  chr6:132017843-132017929
  Hypo

SEQ ID NO: 126485 - DNA, 158 bp, Homo sapiens; identical to SEQ ID NO: 94754
  chr6:132128512-132128670
  Hyper

SEQ ID NO: 126486 - DNA, 30 bp, Homo sapiens; identical to SEQ ID NO: 30828
  chr6:132271740-132271770
  Hyper

SEQ ID NO: 126487 - DNA, 1018 bp, Homo sapiens
  chr6:132722029-132723047
  Hyper
gtctattaagtggggcgctggggacaggaaagtgttcaaagaaggaaacctgcctggggtcatccgtgctcggcttccctaccgcgcgccttctggggctccgggagagcaggcgctgcccgcggaggcgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagg

SEQ ID NO: 126488 - DNA, 2541 bp, Homo sapiens
  chr6:133561700-133564241
  Hyper
ctagagaagctctgacgccgccttggaagtaagtcgttgctgcctgacctttgggcgtctgggacggatgcctatacctgcacccagcagcactggaaggggcccaggcccttcgcagcacagcctatccccagaccgcttagtccttcataacatatatctccacggaaaagggtatttcctcccgtcagaaaaagcgccccagtctggtctgggttggtttttatttcacgttgttgcaagtaggcgaagtcccttctgtctcctcccttggggtaagtggaaaggagtccggcagggggcccgcagtggcctgcacaggggaactgggtagcgagagagttccaggcaattccgggggctgccccacagaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccccccgcgtccctggcggcctcccccgaggcccccggcggcctcacgagcccgcagtagccggtggcgacgtcgcccccgccccacctccctgcgcaagtgcgaggctgccggcagcgcggcgcacgctccggccgttcccggcttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcctgagggcccgggccgctcggaccgcagcggtgctctctgccctagaagacgtccccaagccccaagggtcccttccgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtcattcatgaatcttaacctgagggcaggggaggaaggtgcaggtccctctgccctttctgccaaggtgcagaatagcgcccgggcgtgtgttttggttccagagcagttccacgtggagcaacttcgtgtgtgtgtgtgt

SEQ ID NO: 126489 - DNA, 30 bp, Homo sapiens; identical to SEQ ID NO: 94764
  chr6:133894955-133894985
  Hypo

SEQ ID NO: 126490 - DNA, 93 bp, Homo sapiens; identical to SEQ ID NO: 40896
  chr6:134067455-134067548
  Hypo

SEQ ID NO: 126491 - DNA, 170 bp, Homo sapiens; identical to SEQ ID NO: 94766
  chr6:134175884-134176054
  Hyper

SEQ ID NO: 126492 - DNA, 1179 bp, Homo sapiens
  chr6:134210188-134211367
  Hyper
tgggctgcaaggatccgcccctctattccccagataaattcctagtgtccaccaaattcctcagcgctcgctcaccctcctctacggccacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccaggcgcgcccgcactcccgcctgcggtgggcgcgagtgcgcgcggggctgggagtgggggtgtgggcgcggcggtgacttacacatctcgaccaccgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacactgacaagacgctgcgagcggacaggcattttg

SEQ ID NO: 126493 - DNA, 113 bp, Homo sapiens; identical to SEQ ID NO: 94769
  chr6:134212308-134212421
  Hyper

SEQ ID NO: 126494 - DNA, 486 bp, Homo sapiens
  chr6:134213916-134214402
  Hyper
ttctaacaataaacccgcatgcctgccttttggttgctgttagcgggtgcgtttagctcccgccacgacttccggcggactgggtttaatttaaacattttccaggctacggaacagctcctaagggaagattaagttgagataaacagagaagcaaggccgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtccc

SEQ ID NO: 126495 - DNA, 97 bp, Homo sapiens; identical to SEQ ID NO: 8736
  chr6:134216904-134217001
  Hyper

SEQ ID NO: 126496 - DNA, 91 bp, Homo sapiens; identical to SEQ ID NO: 30841
  chr6:134217370-134217461
  Hyper

SEQ ID NO: 126497 - DNA, 299 bp, Homo sapiens; identical to SEQ ID NO: 30842
  chr6:134499553-134499852
  Hyper

SEQ ID NO: 126498 - DNA, 86 bp, Homo sapiens; identical to SEQ ID NO: 40897
  chr6:134589500-134589586
  Hypo

SEQ ID NO: 126499 - DNA, 86 bp, Homo sapiens; identical to SEQ ID NO: 40898
  chr6:134589886-134589972
  Hypo

SEQ ID NO: 126500 - DNA, 296 bp, Homo sapiens; identical to SEQ ID NO: 94777
  chr6:134638707-134639003
  Hyper

SEQ ID NO: 126501 - DNA, 39 bp, Homo sapiens; identical to SEQ ID NO: 94781
  chr6:136443399-136443438
  Hypo

SEQ ID NO: 126502 - DNA, 20 bp, Homo sapiens
  chr6:136556311-136556331
  Hypo
gccaccgcacctggcctgat

SEQ ID NO: 126503 - DNA, 137 bp, Homo sapiens; identical to SEQ ID NO: 40899
  chr6:137144480-137144617
  Hypo

SEQ ID NO: 126504 - DNA, 1428 bp, Homo sapiens
  chr6:137241818-137243246
  Hyper
ctttggctgaagtgtcgcgttcagcacagaggtggaagtaagaggcagaaaacagaagaaccacgagagaaatggatcctgtctattaaggcaacgtgatgcagcgctaaaaggttaggaggttacgattcccggggctaagagaaataaactgctggtggtgaacgaaaggggtgctggagcgcagcgatctcgaacctttcccttatagccaaaccctggccaaggccacaaatttcaaatcgcctgaaaaccaaactgtctggcgcttaacggttacctcggctgagcgaaacccttggctgctgctgatttaactacaggtccgcgcgagttactttccagggaactgaattcagaacaaagagttaccgaagccttactccctctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttcatctttgcctcagttcgaatgtgtccccgccaccaggccccgctgctgggcgagaccactgaaccccctgaaagcttccccggagccgcgcgcataatcccgggaccctctctggaaggcgtgcggagagcggtgcgcgtggcctggcaccggaaggagccagcttccgggctccgaggcaccccctggacagcgccccgggccgcgggttcctcctccgatgcccgggcgtcgtcgccgggatcgggagcttcgggggcccgccggcaccgacggttttcgcttccctggcgggcagctggacgaggtcccgccgctgcaccgggagggacagtgggtggaaaaagccgctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcgtcttccctgacggtgaaaccgcgcgggacacaacccac

SEQ ID NO: 126505 - DNA, 1495 bp, Homo sapiens
  chr6:137243458-137244953
  Hyper
cgccgccgcgctgggcgggcgcccccgccgccctcactccgctgctcccggctcctcgcgcgcaggtcgcggagctccgccaccgctgggtgcggcgaggccggcgcgatgcggcagctgtgccggggccgcgtgctgggcatctcggtggccatcgcgcacggggtcttctcgggctccctcaacatcttgctcaagttcctcatcagccgctaccagttctccttcctgaccctggtgcagtgcctgaccagctccaccgcggcgctgagcctggagctgctgcggcgcctcgggctcatcgccgtgccccccttcggtctgagcctggcgcgctccttcgcgggggtcgcggtgctctccacgctgcagtccagcctcacgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagactgaggcagagagagccggagagctttgagagtggtcgctcagctcgcaaaagggacttccgagacccagagagctccccagcgccccaccaagtccccctgccccctaatgtcctggcttccgaccctcgcccatgcttcacccggcatcgcccttcctgtcgccccctctcctggtcttcccctgtcaccccattctccgggagaggtgggagggccgcctgagcctgggagctggagtcctccaagcctggaccaagccggaaggagggggccgtgaacttccttgggtcacgaggggctggaatggaggtgggggatgggggcgaagctgagggttcccggggctactgcggggtgtctcgtgctgcgcagggggctgcggccctggggcagacgacccaggtgctgagcgagacgagagcctgggcagggggaagcttcactgggggccagaacaggcgttctcccccgcgcctggcccgctccgggttgcaggccactggctggggctccctctccctttggtgccccacggggcaggggctccggggtgcaggtaccacgcgcccaagtgacctcggtgccagctcggggaagccacagcacctgccccgagggcatctgcgctctccggggcctttgtcttggacagaggaagatggagtgacccggggatatggcgggaaggcgctctgagcactgagtttggctgtcgcatttgacacgggtggccgagggacggcgggcgtctgtcactcaggaatccggtgggcagagctggggcgcgaacccagtctcctttcctacccgacgcgttttccccgtgggtccccgccc

SEQ ID NO: 126506 - DNA, 89 bp, Homo sapiens; identical to SEQ ID NO: 94788
  chr6:137310853-137310942
  Hyper

SEQ ID NO: 126507 - DNA, 222 bp, Homo sapiens; identical to SEQ ID NO: 30851
  chr6:137311158-137311380
  Hyper

SEQ ID NO: 126508 - DNA, 46 bp, Homo sapiens; identical to SEQ ID NO: 94790
  chr6:137365956-137366002
  Hyper

SEQ ID NO: 126509 - DNA, 40 bp, Homo sapiens; identical to SEQ ID NO: 94791
  chr6:137366320-137366360
  Hypo

SEQ ID NO: 126510 - DNA, 2542 bp, Homo sapiens
  chr6:137808752-137811294
  Hyper
ggaggagaaaggagtcgccataaaatgcacccgcgccaccctccatgtcccccagtggaattgaggatcttgcttgtggcaaaagtgcgttcttggcaccacagccccgcagctggggaggggggcctcagtacccggcttccgcaattttccaggcgtggaggtgaggggtgcttgcgtgtaaactgtggcaacccccagaatcaggccctggctcctgcactttcggaggtgtctgttgcagaccacgaggaaaagaggggtcttactcaagtcagggccggacagaactccaaaacttacgaggacagctatccaacactgcctcacagacccttaggcgctgccccctctttgcccctgtcctcctgcggtgcgagaaacccgaccactctgcttctacccgaaccccaggacgcaacagtaaaatcaaggcccgtcgttgaactcccaggtctgcgcatccctccctcctggctccctggggtcttggccccagcaggtccagtacccatccccagagggacccactaccctgggcgtcccagggtgccaggcacgatggcctgcaatgggggctgcaatttaaccgaggcgagttaaattccttttgccggtgcctggctgcgaggacaaacgtccgtactttcgttcgggagccacgggcagtccaggggcttgggttagaagcaacggctctcttccaggggctgtgatccgggtcggccagggagagcgaggccccggggtcctctgtgaggtccccagcgaagagacgcagctggggaaggcgccgcccccgggccccctgcgccaccctaaccgggcctctccttagcaaagttgacaaattcttgagagtgtcagcccagggctgcgcgtgagggcgctgggaccggggaggaaagagcacctgccgcgctcagcccgactttgaatttgtttgttgttaccgtttttgtttttcctcccagtttccataaacgcttagtatttcgaggcactttgcaggtgttggcgcaggtgatgatgggcctcgttggactctgcctcccacgcatccttttgttttctgcgcgccagcctgtctgactgtgtcctgcggggaccccgagacagtccggggtcagggcgtagagactcatgcttgccacttgacccatccgcaacccggggaccccctagcccgtcgcggagctggagtttgggcttccggctcccagctctccgccctggatacaggaagagggcgggagaggtcgcgcacccgcgccgctcggcggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctcagcggtcccagaaacaaagatctagtgagcccagccgacgccggcctcattttccctttctaagggtcactttcttccgccctctaaattaggtcatcgcctgggaaagcgccgagaggtttctagtgtgggcttctcaaggtgtctccgcccaggaggatttcgccatccatttaaacgtaaggcggggtttaatctggaatgaaaggatcgtcgtggtgtttccagattgaatgaaaaactaaacttgcaaaatttcgagaaagtgacaagtttacaacgaaaaaaaatcccggccgaaacccattttcacctttgcggtcatgaaatctt

SEQ ID NO: 126511 - DNA, 2415 bp, Homo sapiens
  chr6:137813536-137815951
  Hyper
agagagagccaaccccgcatgcagaataactgagcgagggggggtggcgcaagctactagagggagcccaggcttttacaatagcggccccagaacagcaaaggaaggttccgaataaagtttgaagggggtgggggtgggagaagaagcgcgtgtgcgtgagtgtgggtctttgcactctgccccttttttcatttcatacaaccacagacagatatatggagtacttgggataattcactaataaatccttgttacaaggaaaacggcaccacagcctgcacgacatattcagacaagattcatttagaagcgtgcatgcattcttttgacctacactgcgtcgaaaggaaaacccacataggaggtgtcatgccctggacctcggttgagattcaaaacttgggtcttgatctctctcgcgctctctctctctttctctctccattgtctctagaaaaactgtggcaaggacagagacaatcataatcgcatccatctcaagaaaatatttacatttgttttgcacaaaagggatggccgtctttttccaaagcgagaacacagagtcagagaaagccaactcaaaagtcccttcgcaagtttttaactacaccgatcccatctttatacaacaaatgcagttttgacaagagcatatggcagtgaaaaatactggcgcggcatggggaaaagaagcatgcatgcaaaacacacgacatctggttcgagtccccctttgctaccacctagaaattgcggtttgattttggtcctttccctccgggggtcaagtggagtctgagatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccagcccagtgctggaagccgctgcccagctgcagcgcgggcggcgtggagggcgccttgagtagcgagtggggaggccggatggtgccgatggcgggaagtgaggcggcggacagcggtgacgaggcgttgccagatgagagcgcgccgcccaagatggggtgcaccgggtgcacggagttggccgcgtgcgcggggtggccggccgagtggcccacggtcccgcagtgaaaggccgagtggtggcccccatagatctcgccaaccagcctcttcatctcctccagggagctggtgagcatgaggatgtagtttctggcgagcaggagtgtggcgatcttggagagcttgcgcaccgacggcccatgcgcgtagggcatgacttcgcgcagcccgtccatggctaggttcaggtcgtgcatccgcttgcgttcgcgtccgttgatcttcagcctcaactgctgtaggtcctgctccgacagctgcttcttgattttgtacttgctgctctctcccgcggccttggcgccagcccgcgagaggctttccccgggcatcttctgcatcatatcgccctgcgtggacgagaccgagttgagacggctctcctggtggtggtggtggcggtggtggtggtccctcaggtacatctcatccatgtccggagatgaagctctgctggagacagagctcgaatcagaattcattttattacaggggatgcggccctaccgtggggaggctttaggcgggaaattaaagaaaatcttgaattaaaaaaaaaaaatctgcactgcccaggaacccacttctccgcggcaagacgtgagaagaaaagcggagacgctgcttttccccgcctctctccctcccacgcccctctctctggttaggctgcttcctggacagctagttggtgtgtgcttgaactaacctcacgctgaaaaagaggggcttttatagagctgcggcggagaaaagagacaaaaggagccctcctatctatcctgggctggttaggatgacgtgccatcattcagggcggtgcgctttgctgtcccatttagcaaggattcctattcatattcattgtggggccgccctgggacacctctgctccgaaccgctaggagcccccaggcacaaaaccctctgattgacacactcaccgctccagcttacgccttcctgattttttttttaactttcttccaccccaccccccttcccaatttctctaaccaaatcacacatcaggaacggaaggaaggcaagagaaggtggccaggcggttggtggaggttcctctgagtttggagagaggaattgaaacattcgctctcctttcttt

SEQ ID NO: 126512 - DNA, 815 bp, Homo sapiens; identical to SEQ ID NO: 94800
  chr6:137816459-137817274
  Hyper

SEQ ID NO: 126513 - DNA, 2143 bp, Homo sapiens
  chr6:137817618-137819761
  Hyper
agtggctagtcctaacgacaaccctctgcgactcccctgctgatcaaatggggtgaggagagagaggcggacgggggagggcattgggagcgagcactggactggacgaagagcagcttccccgccctgcggacggtgcacaggtctggcccccgccgtcctcctgagccacctccctgaccctaggtcgtcggcggcgtctgtccttcccacacccagactgaaaacgctgcacctgagttttgatttggggaagtagaattgtctggtcagagcagaagggttgcaaatgaaggagtggaaaaatcatgttgctacaagatattttaccctttaaaaaaagtcttgattttcccagtggacaatgtaaaataaagttttaaaatctcccccaaattagtaacgaaggtggcaagccgtgggcggggggaggggagggaaggagggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcggggcttgacaactagacgaggggagtgagtaaaggtgccacaactttgcttaccgtaaaatgggttaatactcgccggggcccaaaaggctgagtcgccccgcacgtcttgcttcgtggagtctcttttcgacccccgccaccgcagctcagttcctcggattgagccctgaacccgagaaggagcaggcccggagctcaggagggcaggcacacggatttctttctgagggctgactaccaacgcccaccccagacttgtacggaaggagagagtaaaggagtcgccgcctggccaaggctgcagcagcctacagaggctcagccggagacgcaccatgaccttggccctggccgagacccctttcggagggctcagaccggcgaggagccggagcgagcgaccctgctgcggtggctcgggctgcgctctctcgggccacaccccgcgccctcgcggctggggcgggctgcgccgcggaggcggggatcgttctccggcaacaggtgcgtcccaaggcaggcaggctacttccctccaagcctgtcttggctctgagaagagcctggagtttctcagccttcctacaacatatgaaaacagcgggtcggcgcgtggaccggggcagaagagccgtcctgctgtacccgcgcgcccagggcgctccgcggggaccgcgcactcgggaagctgtgctgtgctcaacacccccctgtgcctcccagatcaccagggatcgtctcttacctgacacccagtgcgcgccgctcggtgcccgacgcccactgctccgcagccttagccaccgagttcctctccagcagctgccggctctgcctgaggccgcggcgattttggctcaggagcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctgtgggcttcacctttcaacccaaccaccctccaagacaaaacagaacaaaaaaaggaaacctaaacatttctaactatgtttcctcatgtgcaaacaaggaatagcctaaaaattagttgaccacgcggagaaacttctcaaaaagtgcattctttagcagagtagaacgataacttcacaacaatagcagtgggggtccggtcaccagggccg

SEQ ID NO: 126514 - DNA, 38 bp, Homo sapiens; identical to SEQ ID NO: 94815
  chr6:138753177-138753215
  Hypo

SEQ ID NO: 126515 - DNA, 157 bp, Homo sapiens; identical to SEQ ID NO: 94816
  chr6:138790419-138790576
  Hypo

SEQ ID NO: 126516 - DNA, 30 bp, Homo sapiens; identical to SEQ ID NO: 94826
  chr6:139645132-139645162
  Hyper

SEQ ID NO: 126517 - DNA, 33 bp, Homo sapiens; identical to SEQ ID NO: 94827
  chr6:139720812-139720845
  Hypo

SEQ ID NO: 126518 - DNA, 408 bp, Homo sapiens; identical to SEQ ID NO: 94831
  chr6:142409841-142410249
  Hyper

SEQ ID NO: 126519 - DNA, 30 bp, Homo sapiens; identical to SEQ ID NO: 94832
  chr6:142444970-142445000
  Hypo

SEQ ID NO: 126520 - DNA, 249 bp, Homo sapiens; identical to SEQ ID NO: 94833
  chr6:142622714-142622963
  Hyper

SEQ ID NO: 126521 - DNA, 334 bp, Homo sapiens; identical to SEQ ID NO: 94835
  chr6:143247641-143247975
  Hyper

SEQ ID NO: 126522 - DNA, 108 bp, Homo sapiens; identical to SEQ ID NO: 94836
  chr6:143248343-143248451
  Hyper

SEQ ID NO: 126523 - DNA, 312 bp, Homo sapiens; identical to SEQ ID NO: 94837
  chr6:143557301-143557613
  Hypo

SEQ ID NO: 126524 - DNA, 30 bp, Homo sapiens; identical to SEQ ID NO: 94838
  chr6:144277296-144277326
  Hypo

SEQ ID NO: 126525 - DNA, 144 bp, Homo sapiens; identical to SEQ ID NO: 94839
  chr6:144521927-144522071
  Hypo

SEQ ID NO: 126526 - DNA, 55 bp, Homo sapiens; identical to SEQ ID NO: 94840
  chr6:144607633-144607688
  Hyper

SEQ ID NO: 126527 - DNA, 152 bp, Homo sapiens; identical to SEQ ID NO: 94841
  chr6:144622994-144623146
  Hypo

SEQ ID NO: 126528 - DNA, 149 bp, Homo sapiens; identical to SEQ ID NO: 94842
  chr6:146349147-146349296
  Hyper

SEQ ID NO: 126529 - DNA, 282 bp, Homo sapiens; identical to SEQ ID NO: 94843
  chr6:146349511-146349793
  Hyper

SEQ ID NO: 126530 - DNA, 454 bp, Homo sapiens; identical to SEQ ID NO: 94844
  chr6:146755460-146755914
  Hyper

SEQ ID NO: 126531 - DNA, 117 bp, Homo sapiens; identical to SEQ ID NO: 94845
  chr6:146864391-146864508
  Hyper

SEQ ID NO: 126532 - DNA, 116 bp, Homo sapiens; identical to SEQ ID NO: 30871
  chr6:146864762-146864878
  Hyper

SEQ ID NO: 126533 - DNA, 113 bp, Homo sapiens; identical to SEQ ID NO: 94847
  chr6:147828093-147828206
  Hyper

SEQ ID NO: 126534 - DNA, 246 bp, Homo sapiens; identical to SEQ ID NO: 94848
  chr6:147829255-147829501
  Hyper

SEQ ID NO: 126535 - DNA, 39 bp, Homo sapiens; identical to SEQ ID NO: 94849
  chr6:147829759-147829798
  Hyper

SEQ ID NO: 126536 - DNA, 74 bp, Homo sapiens; identical to SEQ ID NO: 94850
  chr6:147830039-147830113
  Hyper

SEQ ID NO: 126537 - DNA, 113 bp, Homo sapiens; identical to SEQ ID NO: 94851
  chr6:147830462-147830575
  Hyper

SEQ ID NO: 126538 - DNA, 30 bp, Homo sapiens; identical to SEQ ID NO: 94852
  chr6:147886875-147886905
  Hypo

SEQ ID NO: 126539 - DNA, 30 bp, Homo sapiens; identical to SEQ ID NO: 40903
  chr6:147981884-147981914
  Hypo

SEQ ID NO: 126540 - DNA, 457 bp, Homo sapiens; identical to SEQ ID NO: 94854
  chr6:148663337-148663794
  Hyper

SEQ ID NO: 126541 - DNA, 156 bp, Homo sapiens; identical to SEQ ID NO: 94855
  chr6:148664007-148664163
  Hyper

SEQ ID NO: 126542 - DNA, 163 bp, Homo sapiens; identical to SEQ ID NO: 94856
  chr6:149068767-149068930
  Hyper

SEQ ID NO: 126543 - DNA, 320 bp, Homo sapiens; identical to SEQ ID NO: 94857
  chr6:149069188-149069508
  Hyper

SEQ ID NO: 126544 - DNA, 38 bp, Homo sapiens; identical to SEQ ID NO: 94858
  chr6:149069731-149069769
  Hyper

SEQ ID NO: 126545 - DNA, 99 bp, Homo sapiens; identical to SEQ ID NO: 40904
  chr6:149177471-149177570
  Hypo

SEQ ID NO: 126546 - DNA, 71 bp, Homo sapiens; identical to SEQ ID NO: 94860
  chr6:149460105-149460176
  Hypo

SEQ ID NO: 126547 - DNA, 23 bp, Homo sapiens
  chr6:149498669-149498692
  Hypo
aattctccatccaatcgagtctt

SEQ ID NO: 126548 - DNA, 34 bp, Homo sapiens; identical to SEQ ID NO: 40907
  chr6:149772982-149773016
  Hypo

SEQ ID NO: 126549 - DNA, 192 bp, Homo sapiens; identical to SEQ ID NO: 94863
  chr6:149785967-149786159
  Hypo

SEQ ID NO: 126550 - DNA, 20 bp, Homo sapiens
  chr6:149868358-149868378
  Hypo
gccaccgcacctggcggaaa

SEQ ID NO: 126551 - DNA, 23 bp, Homo sapiens
  chr6:150069440-150069463
  Hypo
tgagactccgtctcaatcaaaag

SEQ ID NO: 126552 - DNA, 85 bp, Homo sapiens; identical to SEQ ID NO: 94867
  chr6:150204851-150204936
  Hypo

SEQ ID NO: 126553 - DNA, 425 bp, Homo sapiens; identical to SEQ ID NO: 94868
  chr6:150243820-150244245
  Hyper

SEQ ID NO: 126554 - DNA, 125 bp, Homo sapiens; identical to SEQ ID NO: 94869
  chr6:150246750-150246875
  Hyper

SEQ ID NO: 126555 - DNA, 143 bp, Homo sapiens; identical to SEQ ID NO: 94870
  chr6:150262701-150262844
  Hyper

SEQ ID NO: 126556 - DNA, 1972 bp, Homo sapiens
  chr6:150284667-150286639
  Hyper
gaggcaaaaaaggttcgctccggaatggggaagcggctgcgccctggacggagaggggcggggacttcgcgactgcaggcggagggagggcgggtgtcgctggcgcaggcggtgacagggagacaccgccgccactgagtattcctatgcaagtttcttcatcttcctgtgcatcagtgtttacactggggtaatgataaatgctgtgttgaaaaattatttgatggggccatggaaggaacggaaggaacggcgtcctggcccgctcggggcccgcgcacgccgccaccaagccgcgggggcgggtcggaggggagagttgcgtcagccaggccgctgtcagatgacgagcccggggcgtgacggggtggagcatccccaaaaaagtgcatgcctaggatcccgcccagtgtatccctgcgcgcggcgggccgggctgggcagctttataaacagccgtggtgtgagcctcgaagggaaccatcagcgcctcctgtccacggagctccaggtctacaatggcagcggccgccagccccgcgttccttctgtgcctcccgcttctgcacctgctgtctggctggtcccgggcaggatgggtcggtgagttcggggatgtagcctaagcagggcgggggccaaacctgggaggttgtggactgcagcgggtttcagaggaggggaggcttctggaaggaccggcgcgatctccctgaacgaacatcgcggtctccccgaacgtcgcggtccctccgaacgtcgcggtctccccgaacatcgcggtgcccccgaacatcgctgtctccccgaacatcgcgatctccccgaacatcgtgatctccccagacatgcccagctgaaggcactcagttcccctcggtggctcctttccgccgggtccgcttcctgcggctgctgcttgcccctcaggccaggaggtttctggaaggaccggtgctgtctccccgaacatcgtggtctccccgaacatcgcggcctctccgaacatcgccctctctccgagcaacgcgatctccccgaacatcgcggtctccccgaaaatcgcgatctccccgaacattgccatctcaccgaacatcgcgatctcgccgaacatgcccggctgaaggcactcagttcccctccgcggctcctttccgccgggtctgattcctgcggctgctgcttgccccgcaggccaggaggcttctggtagcaccggcgcgatgcccccgaacatcgcgttctaccccaacatcgcgatccctccgaacatcgtgatcccccccgaacatcgccgtccccccgagtaacgcggtctccccgaacatcgcggtccccccgaacatcgcggtacccccgaacatcgccgtctccccgtacattgcgatcccccgaaacattgcgatctccccgaacatcgcgatctcgccgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctgctgctagcaccgcagtccagggggagtgtcaaagaaggctgaaaaggaattgcaggagggtggagggaccaaaaggctacagagggcaaggtagggcggggatccctggtg

SEQ ID NO: 126557 - DNA, 109 bp, Homo sapiens; identical to SEQ ID NO: 94874
  chr6:150310096-150310205
  Hyper

SEQ ID NO: 126558 - DNA, 39 bp, Homo sapiens; identical to SEQ ID NO: 94875
  chr6:150310414-150310453
  Hyper

SEQ ID NO: 126559 - DNA, 373 bp, Homo sapiens; identical to SEQ ID NO: 94876
  chr6:150311072-150311445
  Hyper

SEQ ID NO: 126560 - DNA, 462 bp, Homo sapiens; identical to SEQ ID NO: 94877
  chr6:150311753-150312215
  Hyper

SEQ ID NO: 126561 - DNA, 98 bp, Homo sapiens; identical to SEQ ID NO: 94878
  chr6:150312685-150312783
  Hyper

SEQ ID NO: 126562 - DNA, 929 bp, Homo sapiens
  chr6:150358524-150359453
  Hyper
gccaatgagagtggacgcaggcaggggcgggggagcctttcacacatgacttttcatggtttcgatcctgatacacgtgaatatatggaggtgaagtagtaaggaagggtggggccgggagccccggcgacggtcaccagttgagctcgcctgatctgttgtgggctacgagagtccggggacgggcaatctgggcagagtcgcacgaggctgctgcagtgatgaggcactggttctagaaatttacccaacggtgttgtcataggggggacattacaggtgattgctgatttcaaccacagatgactttcggggaaagttctctcctgggggtttctgtttctaccccgccgcgtcctctccgagttctgcgcgctcctcccagggcgcccgctgtccccgagctctggacccgggtcctgcccagtggagaccgcggagttggtgccccgcttgcggccgatgctcccgggcctccgagtccacagcgtccggacaaaacggcctttggaagacctgggaggactcgccggtagcggcaagggaaggagccaggaaatgcgggggtcggtggggtgaggagcacggggttcctacttcatcctcgcggaaactttgccaccggctcagtgtggagacctcaccgtcccgcttggatccgtggggctccggcagtgtggcctccgcgaggacccccatcctccttgccctggggatgctgcgggagggcgcccgggccgcactaggtcctgagtgtccagggtccggcaggggcttcccgttgtcgcctccccgaccccgccgctcgcggtccagggctcctggtttctccactgggctgggggcccggagcatggacgtcgtgaggcggagaaaaccttgggatgggtggaaaagaaggatcggagagagggcgggagaaagggaga

SEQ ID NO: 126563 - DNA, 30 bp, Homo sapiens; identical to SEQ ID NO: 94882
  chr6:150393330-150393360
  Hypo

SEQ ID NO: 126564 - DNA, 20 bp, Homo sapiens
  chr6:150487217-150487237
  Hypo
tttttttttttgagacggag

SEQ ID NO: 126565 - DNA, 30 bp, Homo sapiens; identical to SEQ ID NO: 40909
  chr6:150985942-150985972
  Hypo

SEQ ID NO: 126566 - DNA, 61 bp, Homo sapiens; identical to SEQ ID NO: 94887
  chr6:151346311-151346372
  Hypo

SEQ ID NO: 126567 - DNA, 1631 bp, Homo sapiens
  chr6:151560965-151562596
  Hyper
tccgtggcctgactgcgttaacctctcggttccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtgggcggctgcctggacctgggctggcgcgtcgcagcgcctctggtcccggcagcctgggggcagatgctgctgcagggcgtgtctggggctgtgctcatgtgatgaagcgagggaaaaaccggggggaggggggcggaggctaagaggtggcctttttttttttttccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtgcgaacccctctttggaggcttttcagggtctttcgcgccggggcggggccagagcagcggcgagcgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctag

SEQ ID NO: 126568 - DNA, 735 bp, Homo sapiens; identical to SEQ ID NO: 94892
  chr6:151814876-151815611
  Hyper

SEQ ID NO: 126569 - DNA, 34 bp, Homo sapiens; identical to SEQ ID NO: 94893
  chr6:151815845-151815879
  Hyper

SEQ ID NO: 126570 - DNA, 151 bp, Homo sapiens; identical to SEQ ID NO: 40910
  chr6:152520849-152521000
  Hypo

SEQ ID NO: 126571 - DNA, 30 bp, Homo sapiens; identical to SEQ ID NO: 94898
  chr6:152539785-152539815
  Hypo

SEQ ID NO: 126572 - DNA, 196 bp, Homo sapiens; identical to SEQ ID NO: 94899
  chr6:152562427-152562623
  Hypo

SEQ ID NO: 126573 - DNA, 579 bp, Homo sapiens; identical to SEQ ID NO: 94900
  chr6:152622914-152623493
  Hyper

SEQ ID NO: 126574 - DNA, 1085 bp, Homo sapiens
  chr6:152957418-152958503
  Hyper
tagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctctcggcctcgttcagtttcccagcagcaaggcgaagcgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccgcggcccggcgcccgcgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggagctgcgctgtcctgccagc

SEQ ID NO: 126575 - DNA, 30 bp, Homo sapiens; identical to SEQ ID NO: 94905
  chr6:153272474-153272504
  Hypo

SEQ ID NO: 126576 - DNA, 625 bp, Homo sapiens; identical to SEQ ID NO: 94906
  chr6:153450977-153451602
  Hyper

SEQ ID NO: 126577 - DNA, 1165 bp, Homo sapiens
  chr6:153451662-153452827
  Hyper
ctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatgggcggtcgcgctctccgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccactcgcccgtagcccgcgcgctgctgtcctgggctgcgcgggagccttgcacccaggagccggcctgccaggcac

SEQ ID NO: 126578 - DNA, 38 bp, Homo sapiens; identical to SEQ ID NO: 94910
  chr6:153472441-153472479
  Hypo

SEQ ID NO: 126579 - DNA, 377 bp, Homo sapiens; identical to SEQ ID NO: 94911
  chr6:154360574-154360951
  Hyper

SEQ ID NO: 126580 - DNA, 99 bp, Homo sapiens; identical to SEQ ID NO: 94913
  chr6:154771265-154771364
  Hypo

SEQ ID NO: 126581 - DNA, 62 bp, Homo sapiens; identical to SEQ ID NO: 94914
  chr6:154796421-154796483
  Hypo

SEQ ID NO: 126582 - DNA, 173 bp, Homo sapiens; identical to SEQ ID NO: 94915
  chr6:154830592-154830765
  Hyper

SEQ ID NO: 126583 - DNA, 103 bp, Homo sapiens; identical to SEQ ID NO: 40911
  chr6:154970495-154970598
  Hypo

SEQ ID NO: 126584 - DNA, 38 bp, Homo sapiens; identical to SEQ ID NO: 94918
  chr6:155281592-155281630
  Hypo

SEQ ID NO: 126585 - DNA, 1314 bp, Homo sapiens
  chr6:155316026-155317340
  Hyper
tgggtcttggagtgccgactcgattgccatctccgctgcgaagccatctcctctcagaaggggaaggagatggaaagtctctgcggccgctgacctcagttttgcgtgcctttcctcggtgggacccgggaagagccgtctttaaattccttggggaagggacggggtcgcactggcgcatcgcatccccggtagcgggcagagcccccagctcacagtgagcgcgtgctcgatgtttcttgaattgttttatttgtgttgttccaaagaaagcgcgagggacatggtccgggaccagccgggagctggcgcgggggtcctgggcctgacgctgggcggggctggggcgtgtccggggcggggcggggcgggaggtgcggtcgcggctcgggcctggcaggcgctgcgcgcggggctggggcagcggtaaccgtaactgtggccgcggccgccgcaggcgcacagcgcgcgtccaagtggagaacaaagtgacccccagaacttctccaactcctcccggcgttcccgcgagggccacgcgccgagggtagcggagggcggcgcgcgaccggccccaccgagcccggcgcgcgacccgaggtaaggggcgcccgggtgagggcgcaggagggcgacgacccgcgctggttggcggcggctccaggtcccctgcgggcggggcggcgcgcggccggcggtcccctcccttcccctttgttggccgcccctctctgcccccgctttcctgggagtcccgcggaaggtcgcggctgcggggcgcggcctggcaccctctccccggagggcggcagcgtccgggcacagcctggcacgggggacgaagcactttccagaaggctctgaaactaggtcccctggtcccctcgcgctgcgcgacacgccaggacccactttcagccccggtcccatcccggatgggaggaggcggcgccccggcctcctgataccgaggttctcgcccaaagccgagccgtgggtgcccggaggggagcgcccgctgcgcccacgcccgcccggcgacctcggagcctcagaaaggcgctgcggcgaagcaggatcccaggcggtcggctcagcgagtgtagaccgtgcggtccctgctcagcccctccggcctttccgagcgcgggagccatcccggacgggcgcggctcctgggggggctgaggtgccaagtttctgtgaaagccgacacgttgtgcccctaatggatcctatttaccaaaaacagttcagaaagaaaagagtccattcttccagccattcgttgctgacagccgctggaaaggtctg

SEQ ID NO: 126586 - DNA, 30 bp, Homo sapiens; identical to SEQ ID NO: 94921
  chr6:155438513-155438543
  Hypo

SEQ ID NO: 126587 - DNA, 140 bp, Homo sapiens; identical to SEQ ID NO: 94922
  chr6:155568772-155568912
  Hypo

SEQ ID NO: 126588 - DNA, 74 bp, Homo sapiens; identical to SEQ ID NO: 94923
  chr6:155569275-155569349
  Hypo

SEQ ID NO: 126589 - DNA, 30 bp, Homo sapiens; identical to SEQ ID NO: 14887
  chr6:155988231-155988261
  Hypo

SEQ ID NO: 126590 - DNA, 158 bp, Homo sapiens; identical to SEQ ID NO: 94925
  chr6:156817422-156817580
  Hypo

SEQ ID NO: 126591 - DNA, 30 bp, Homo sapiens; identical to SEQ ID NO: 94926
  chr6:157040065-157040095
  Hypo

SEQ ID NO: 126592 - DNA, 179 bp, Homo sapiens; identical to SEQ ID NO: 94927
  chr6:157103443-157103622
  Hyper

SEQ ID NO: 126593 - DNA, 30 bp, Homo sapiens; identical to SEQ ID NO: 94928
  chr6:157255695-157255725
  Hypo

SEQ ID NO: 126594 - DNA, 30 bp, Homo sapiens; identical to SEQ ID NO: 40915
  chr6:157283403-157283433
  Hypo

SEQ ID NO: 126595 - DNA, 30 bp, Homo sapiens; identical to SEQ ID NO: 94930
  chr6:157301697-157301727
  Hypo

SEQ ID NO: 126596 - DNA, 30 bp, Homo sapiens; identical to SEQ ID NO: 94931
  chr6:157431645-157431675
  Hypo

SEQ ID NO: 126597 - DNA, 30 bp, Homo sapiens; identical to SEQ ID NO: 40916
  chr6:157455406-157455436
  Hypo

SEQ ID NO: 126598 - DNA, 193 bp, Homo sapiens; identical to SEQ ID NO: 94933
  chr6:157478285-157478478
  Hypo

SEQ ID NO: 126599 - DNA, 30 bp, Homo sapiens; identical to SEQ ID NO: 94934
  chr6:157502438-157502468
  Hypo

SEQ ID NO: 126600 - DNA, 48 bp, Homo sapiens; identical to SEQ ID NO: 40918
  chr6:157505817-157505865
  Hypo

SEQ ID NO: 126601 - DNA, 30 bp, Homo sapiens; identical to SEQ ID NO: 94936
  chr6:157506082-157506112
  Hypo

SEQ ID NO: 126602 - DNA, 1110 bp, Homo sapiens
  chr6:157556754-157557864
  Hyper
aaccatttctaaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggccggctcaggtggcggccccaccccagcgcccttcagcaggcctgggtcggtcggcctcggaccccgtaggcgccggcggagctggcggcagggacccgacagctctgccgcggactccgcaggggacatcccccaccctggcggcccacccaggcggagcgcggcggggaccgtgcatctagcgcgccctggtgacctgcgggccgaggcgggctgtggggcttggccccgcgactcagccttccgggcccacagcggccctgacccgggaagtgcggaggtttggccgccttcaacagcacctgccaggccactgggagcagcgggggagaagtgggctcgcacaccgacggcctcccgggttcggcggggacgacccgagctaggagcccgcgggggccgtgggagctgctccgccgaggtggacccggggcgcccgcacccctcaccttctttccgtggggtccggggccagggacgcagcgggggacggcgggcatcagccgggcagcgcccgagccgtccctggccgggtccccacacctgcgtgctcgggcatccccaggg

SEQ ID NO: 126603 - DNA, 31 bp, Homo sapiens; identical to SEQ ID NO: 94938
  chr6:157637384-157637415
  Hypo

SEQ ID NO: 126604 - DNA, 84 bp, Homo sapiens; identical to SEQ ID NO: 40920
  chr6:157638362-157638446
  Hypo

SEQ ID NO: 126605 - DNA, 256 bp, Homo sapiens; identical to SEQ ID NO: 94940
  chr6:157912932-157913188
  Hypo

SEQ ID NO: 126606 - DNA, 38 bp, Homo sapiens; identical to SEQ ID NO: 94942
  chr6:158072190-158072228
  Hypo

SEQ ID NO: 126607 - DNA, 307 bp, Homo sapiens; identical to SEQ ID NO: 94943
  chr6:158093775-158094082
  Hypo

SEQ ID NO: 126608 - DNA, 30 bp, Homo sapiens; identical to SEQ ID NO: 14891
  chr6:158119028-158119058
  Hypo

SEQ ID NO: 126609 - DNA, 30 bp, Homo sapiens; identical to SEQ ID NO: 94945
  chr6:158245801-158245831
  Hypo

SEQ ID NO: 126610 - DNA, 154 bp, Homo sapiens; identical to SEQ ID NO: 94946
  chr6:158430536-158430690
  Hyper

SEQ ID NO: 126611 - DNA, 184 bp, Homo sapiens; identical to SEQ ID NO: 40924
  chr6:158489608-158489792
  Hypo

SEQ ID NO: 126612 - DNA, 30 bp, Homo sapiens; identical to SEQ ID NO: 94949
  chr6:158937301-158937331
  Hyper

SEQ ID NO: 126613 - DNA, 35 bp, Homo sapiens; identical to SEQ ID NO: 94950
  chr6:158957282-158957317
  Hyper

SEQ ID NO: 126614 - DNA, 241 bp, Homo sapiens; identical to SEQ ID NO: 94951
  chr6:158957747-158957988
  Hyper

SEQ ID NO: 126615 - DNA, 489 bp, Homo sapiens; identical to SEQ ID NO: 94952
  chr6:158958194-158958683
  Hyper

SEQ ID NO: 126616 - DNA, 30 bp, Homo sapiens; identical to SEQ ID NO: 40925
  chr6:158978998-158979028
  Hypo

SEQ ID NO: 126617 - DNA, 79 bp, Homo sapiens; identical to SEQ ID NO: 94954
  chr6:158982731-158982810
  Hypo

SEQ ID NO: 126618 - DNA, 138 bp, Homo sapiens; identical to SEQ ID NO: 94955
  chr6:159049745-159049883
  Hypo

SEQ ID NO: 126619 - DNA, 21 bp, Homo sapiens
  chr6:159081339-159081360
  Hypo
gaacagcgcctggggtgttca

SEQ ID NO: 126620 - DNA, 30 bp, Homo sapiens; identical to SEQ ID NO: 40928
  chr6:159113607-159113637
  Hypo

SEQ ID NO: 126621 - DNA, 22 bp, Homo sapiens
  chr6:159151570-159151592
  Hypo
ggcgccccactgcctcgttgcg

SEQ ID NO: 126622 - DNA, 21 bp, Homo sapiens
  chr6:159151652-159151673
  Hypo
gcaacgcggaaagaaagcagc

SEQ ID NO: 126623 - DNA, 35 bp, Homo sapiens; identical to SEQ ID NO: 94960
  chr6:159151892-159151927
  Hypo

SEQ ID NO: 126624 - DNA, 50 bp, Homo sapiens; identical to SEQ ID NO: 94961
  chr6:159194739-159194789
  Hypo

SEQ ID NO: 126625 - DNA, 30 bp, Homo sapiens; identical to SEQ ID NO: 94962
  chr6:159195237-159195267
  Hypo

SEQ ID NO: 126626 - DNA, 30 bp, Homo sapiens; identical to SEQ ID NO: 94963
  chr6:159228054-159228084
  Hypo

SEQ ID NO: 126627 - DNA, 265 bp, Homo sapiens; identical to SEQ ID NO: 94964
  chr6:159252784-159253049
  Hypo

SEQ ID NO: 126628 - DNA, 39 bp, Homo sapiens; identical to SEQ ID NO: 94965
  chr6:159270065-159270104
  Hypo

SEQ ID NO: 126629 - DNA, 36 bp, Homo sapiens; identical to SEQ ID NO: 94966
  chr6:159343088-159343124
  Hypo

SEQ ID NO: 126630 - DNA, 46 bp, Homo sapiens; identical to SEQ ID NO: 94967
  chr6:159456944-159456990
  Hypo

SEQ ID NO: 126631 - DNA, 18 bp, Homo sapiens
  chr6:159537157-159537175
  Hypo
agtctggctgctgggcgg

SEQ ID NO: 126632 - DNA, 49 bp, Homo sapiens; identical to SEQ ID NO: 94969
  chr6:159551945-159551994
  Hypo

SEQ ID NO: 126633 - DNA, 164 bp, Homo sapiens; identical to SEQ ID NO: 94970
  chr6:159569246-159569410
  Hypo

SEQ ID NO: 126634 - DNA, 1367 bp, Homo sapiens
  chr6:159589910-159591277
  Hyper
aactgggttccttttcgacccgcatcgtgcgcgccctagaaatgacagccagacggagcagggtctaaggacgctgaaaacccctgacgtgggcgcgccgggtgcgggtagggacgtggaaggactgggctagccacaggaactacagcgctgcggaccgggtgaggggtcccggcccgagtccccacttggggcgcagaggtgtttctgtaaggggacaaagggcactcctcggcgcgatgggcgacttccccagccagaaaatgagagggttagacgaggggaggaacttcctcagccacttggcccggcacagcgaccgccccaagttcagaaccgctaagtcagtccggggcgctccggccccttcgtcccgcgccccgcccgcctccagcccgggccccgccgcccccgtcgcccctgtcgcccgggtcgcccccgccggccctggccccggccccgcacaccggcagggggcgcccgagcgcagctaaaaggctcggcgggaggtcggcggcctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcaggtacgcgccgcgcccgggcccccggcgctcctcagctccccgcgcaccctcctgcgctcgggccccgtcgtcccgctcagtgctggctacgggtcgtgtcactagcctgtgcgtcctcgtcactcgcgggtcggggcacttggcgccctgtgtgggtggcgggagcggggacgcctcggtgcccggggaccgcagcgcgctggcgtttaactttgccgtcgcccgccttggagtcgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaagcgctccagtgccagc

SEQ ID NO: 126635 - DNA, 30 bp, Homo sapiens; identical to SEQ ID NO: 94974
  chr6:159653218-159653248
  Hypo

SEQ ID NO: 126636 - DNA, 106 bp, Homo sapiens; identical to SEQ ID NO: 30908
  chr6:159654897-159655003
  Hyper

SEQ ID NO: 126637 - DNA, 30 bp, Homo sapiens; identical to SEQ ID NO: 94976
  chr6:159660826-159660856
  Hypo

SEQ ID NO: 126638 - DNA, 30 bp, Homo sapiens; identical to SEQ ID NO: 94977
  chr6:159925862-159925892
  Hypo

SEQ ID NO: 126639 - DNA, 58 bp, Homo sapiens; identical to SEQ ID NO: 94978
  chr6:160248421-160248479
  Hypo

SEQ ID NO: 126640 - DNA, 30 bp, Homo sapiens; identical to SEQ ID NO: 30909
  chr6:160402852-160402882
  Hyper

SEQ ID NO: 126641 - DNA, 61 bp, Homo sapiens; identical to SEQ ID NO: 94980
  chr6:160450704-160450765
  Hypo

SEQ ID NO: 126642 - DNA, 30 bp, Homo sapiens; identical to SEQ ID NO: 94981
  chr6:160476041-160476071
  Hypo

SEQ ID NO: 126643 - DNA, 310 bp, Homo sapiens; identical to SEQ ID NO: 94983
  chr6:160511899-160512209
  Hypo

SEQ ID NO: 126644 - DNA, 634 bp, Homo sapiens
  chr6:160769301-160769935
  Hyper
ggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgctcggctccccttgtgccgtgccgcggcggctggcgctacgcccaggcccactccaccatcgtcagcgaggtaagggcgccccggccctttggaagccggcgggagaggacgatgctggctccca

SEQ ID NO: 126645 - DNA, 61 bp, Homo sapiens; identical to SEQ ID NO: 94986
  chr6:160770239-160770300
  Hyper

SEQ ID NO: 126646 - DNA, 30 bp, Homo sapiens
  chr6:161100496-161100526
  Hyper
ccactactaccacctcgtattttgcagcct

SEQ ID NO: 126647 - DNA, 376 bp, Homo sapiens
  chr6:161188236-161188612
  Hyper
gcctcgtccacccctcgtccacccctccgcctcccgccccggcaccacgccgcgcccgcgtccccgcccagtgcccgcgcctttgcgggccccggtcctgcggggcccctcgcgcactccagaagcatcagtatcctccgggcggccacgggccagctgcggctcccaccctggcgaccctggattgctctccccattctcagcctcaccccccactccttccaccccatattttgccgcctcgaaggacatgaaccatctgctggctgaaggcgcttggacctgaaaccagcgacaggttttggcagctgcacgctcactcccagggaggcgagggcgcccggcgaagtgtggggtctgccgccccctgccggct

SEQ ID NO: 126648 - DNA, 42 bp, Homo sapiens; identical to SEQ ID NO: 94991
  chr6:161259532-161259574
  Hypo

SEQ ID NO: 126649 - DNA, 512 bp, Homo sapiens
  chr6:161351859-161352371
  Hyper
gcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagtggggcgtaaggctgagagtggggagagcaatccaggggcgccagggtgggagccgcagcgggcccgcggccgcccggaggacactgatgcttctggagctcgcgaagggtcccccgcgggagaggaacaaggccgcttgcgctccgcagaggcgcaggcacggggctggggcccggggcgggggcgcgggtgggcggacccctcccgcaagcccatgatggccaggccaaggccgctgggaaaggcaggacgctcgcccatgcgctgccagctgggcttttctccttcgcccgccctgtgttccagggcgcgaccccgttcggtc

SEQ ID NO: 126650 - DNA, 30 bp, Homo sapiens; identical to SEQ ID NO: 94999
  chr6:161560023-161560053
  Hypo

SEQ ID NO: 126651 - DNA, 121 bp, Homo sapiens; identical to SEQ ID NO: 95000
  chr6:161561655-161561776
  Hypo

SEQ ID NO: 126652 - DNA, 30 bp, Homo sapiens; identical to SEQ ID NO: 95001
  chr6:161575883-161575913
  Hypo

SEQ ID NO: 126653 - DNA, 30 bp, Homo sapiens; identical to SEQ ID NO: 95002
  chr6:161585055-161585085
  Hypo

SEQ ID NO: 126654 - DNA, 188 bp, Homo sapiens; identical to SEQ ID NO: 95003
  chr6:161602138-161602326
  Hypo

SEQ ID NO: 126655 - DNA, 167 bp, Homo sapiens; identical to SEQ ID NO: 95004
  chr6:161609747-161609914
  Hypo

SEQ ID NO: 126656 - DNA, 163 bp, Homo sapiens; identical to SEQ ID NO: 95005
  chr6:161619824-161619987
  Hypo

SEQ ID NO: 126657 - DNA, 186 bp, Homo sapiens; identical to SEQ ID NO: 95006
  chr6:161643685-161643871
  Hypo

SEQ ID NO: 126658 - DNA, 30 bp, Homo sapiens; identical to SEQ ID NO: 95007
  chr6:161656491-161656521
  Hypo

SEQ ID NO: 126659 - DNA, 63 bp, Homo sapiens; identical to SEQ ID NO: 40939
  chr6:161672733-161672796
  Hypo

SEQ ID NO: 126660 - DNA, 175 bp, Homo sapiens; identical to SEQ ID NO: 95009
  chr6:161685567-161685742
  Hypo

SEQ ID NO: 126661 - DNA, 101 bp, Homo sapiens; identical to SEQ ID NO: 95010
  chr6:161690505-161690606
  Hypo

SEQ ID NO: 126662 - DNA, 23 bp, Homo sapiens
  chr6:161726250-161726273
  Hypo
aaaaccagctgaggccgggcgcg

SEQ ID NO: 126663 - DNA, 63 bp, Homo sapiens; identical to SEQ ID NO: 95012
  chr6:161766949-161767012
  Hypo

SEQ ID NO: 126664 - DNA, 79 bp, Homo sapiens; identical to SEQ ID NO: 40942
  chr6:161780140-161780219
  Hypo

SEQ ID NO: 126665 - DNA, 25 bp, Homo sapiens
  chr6:161795264-161795289
  Hypo
tgtgttgtgtatatgcgtatgctgt

SEQ ID NO: 126666 - DNA, 24 bp, Homo sapiens
  chr6:161795349-161795373
  Hypo
tgtgtgtaacgcatggtgtgcatg

SEQ ID NO: 126667 - DNA, 36 bp, Homo sapiens; identical to SEQ ID NO: 40945
  chr6:161989335-161989371
  Hypo

SEQ ID NO: 126668 - DNA, 39 bp, Homo sapiens; identical to SEQ ID NO: 95020
  chr6:162084991-162085030
  Hypo

SEQ ID NO: 126669 - DNA, 30 bp, Homo sapiens; identical to SEQ ID NO: 95021
  chr6:162135996-162136026
  Hypo

SEQ ID NO: 126670 - DNA, 40 bp, Homo sapiens; identical to SEQ ID NO: 95023
  chr6:162222104-162222144
  Hypo

SEQ ID NO: 126671 - DNA, 30 bp, Homo sapiens; identical to SEQ ID NO: 95024
  chr6:162226297-162226327
  Hypo

SEQ ID NO: 126672 - DNA, 17 bp, Homo sapiens
  chr6:162253379-162253396
  Hypo
gtggggtggctctcacg

SEQ ID NO: 126673 - DNA, 17 bp, Homo sapiens
  chr6:162253696-162253713
  Hypo
cgcggaactgtaataca

SEQ ID NO: 126674 - DNA, 177 bp, Homo sapiens; identical to SEQ ID NO: 95027
  chr6:162257854-162258031
  Hypo

SEQ ID NO: 126675 - DNA, 30 bp, Homo sapiens; identical to SEQ ID NO: 40947
  chr6:162280335-162280365
  Hypo

SEQ ID NO: 126676 - DNA, 181 bp, Homo sapiens; identical to SEQ ID NO: 95032
  chr6:162863312-162863493
  Hypo

SEQ ID NO: 126677 - DNA, 23 bp, Homo sapiens
  chr6:162921490-162921513
  Hypo
actgcgcccggcccaaacagcca

SEQ ID NO: 126678 - DNA, 30 bp, Homo sapiens; identical to SEQ ID NO: 95037
  chr6:163521407-163521437
  Hypo

SEQ ID NO: 126679 - DNA, 38 bp, Homo sapiens; identical to SEQ ID NO: 95040
  chr6:163616660-163616698
  Hypo

SEQ ID NO: 126680 - DNA, 95 bp, Homo sapiens; identical to SEQ ID NO: 95041
  chr6:163661684-163661779
  Hypo

SEQ ID NO: 126681 - DNA, 39 bp, Homo sapiens; identical to SEQ ID NO: 95042
  chr6:163673393-163673432
  Hypo

SEQ ID NO: 126682 - DNA, 564 bp, Homo sapiens
  chr6:163834265-163834829
  Hyper
aagacctcttgcctccgtattctttcttcatctgtaaaaatgttgacttctgcttttcagactacgcgcacagcctctttatttcctactgcggcttcattccctcacggaacactgacgccatcgcgaaggaagcatttcgagcacgactgacgctccccttattatttgctaagccgctgcgctcgggtctggctacgatttgctttcagaataacgggaaggtgcaacaagatcgcttccctagaggcgcgtcgcccgcgtggcccggaccccccacgcccgcccgccgccccgtgggtgcgcacgcgtgtccgcgcaggcttcccgcctggcgagtgcaaggctcctctccgccgtgctgctttccagcctctcagcaaatcacgaacaccgaaagaagccacggcggcgacgggaggggcgtcgcgcgtgcttccctcggcgacaaagcgggagccgggcgcgccggccgagggcgcccggcgcagagtcccgcagaggcggacgccgcggcacgcgcctcgaaaagcctcaaactcttatcctcggctctcccgcccc

SEQ ID NO: 126683 - DNA, 48 bp, Homo sapiens; identical to SEQ ID NO: 95047
  chr6:163835083-163835131
  Hyper

SEQ ID NO: 126684 - DNA, 109 bp, Homo sapiens; identical to SEQ ID NO: 95048
  chr6:163835797-163835906
  Hyper

SEQ ID NO: 126685 - DNA, 1034 bp, Homo sapiens; identical to SEQ ID NO: 95049
  chr6:163836197-163837231
  Hyper

SEQ ID NO: 126686 - DNA, 311 bp, Homo sapiens; identical to SEQ ID NO: 95050
  chr6:163837469-163837780
  Hyper

SEQ ID NO: 126687 - DNA, 30 bp, Homo sapiens; identical to SEQ ID NO: 40949
  chr6:163915349-163915379
  Hypo

SEQ ID NO: 126688 - DNA, 35 bp, Homo sapiens; identical to SEQ ID NO: 95052
  chr6:163923060-163923095
  Hypo

SEQ ID NO: 126689 - DNA, 140 bp, Homo sapiens; identical to SEQ ID NO: 95053
  chr6:163945790-163945930
  Hypo

SEQ ID NO: 126690 - DNA, 158 bp, Homo sapiens; identical to SEQ ID NO: 95054
  chr6:163946670-163946828
  Hypo

SEQ ID NO: 126691 - DNA, 30 bp, Homo sapiens; identical to SEQ ID NO: 95055
  chr6:163979710-163979740
  Hypo

SEQ ID NO: 126692 - DNA, 23 bp, Homo sapiens
  chr6:164012441-164012464
  Hypo
tttttgagttgcagccgaagtct

SEQ ID NO: 126693 - DNA, 150 bp, Homo sapiens; identical to SEQ ID NO: 95057
  chr6:164047494-164047644
  Hypo

SEQ ID NO: 126694 - DNA, 32 bp, Homo sapiens; identical to SEQ ID NO: 95058
  chr6:164057505-164057537
  Hypo

SEQ ID NO: 126695 - DNA, 138 bp, Homo sapiens; identical to SEQ ID NO: 95059
  chr6:164064007-164064145
  Hypo

SEQ ID NO: 126696 - DNA, 22 bp, Homo sapiens
  chr6:164114295-164114317
  Hypo
ttatttttttgagaccgagtct

SEQ ID NO: 126697 - DNA, 50 bp, Homo sapiens; identical to SEQ ID NO: 95061
  chr6:164118784-164118834
  Hypo

SEQ ID NO: 126698 - DNA, 30 bp, Homo sapiens; identical to SEQ ID NO: 40955
  chr6:164121841-164121871
  Hypo

SEQ ID NO: 126699 - DNA, 30 bp, Homo sapiens; identical to SEQ ID NO: 95063
  chr6:164136197-164136227
  Hypo

SEQ ID NO: 126700 - DNA, 71 bp, Homo sapiens; identical to SEQ ID NO: 95064
  chr6:164143599-164143670
  Hypo

SEQ ID NO: 126701 - DNA, 160 bp, Homo sapiens; identical to SEQ ID NO: 95065
  chr6:164145352-164145512
  Hypo

SEQ ID NO: 126702 - DNA, 400 bp, Homo sapiens; identical to SEQ ID NO: 95066
  chr6:164149947-164150347
  Hypo

SEQ ID NO: 126703 - DNA, 30 bp, Homo sapiens; identical to SEQ ID NO: 95067
  chr6:164164781-164164811
  Hypo

SEQ ID NO: 126704 - DNA, 92 bp, Homo sapiens; identical to SEQ ID NO: 40959
  chr6:164165801-164165893
  Hypo

SEQ ID NO: 126705 - DNA, 38 bp, Homo sapiens; identical to SEQ ID NO: 95069
  chr6:164170286-164170324
  Hypo

SEQ ID NO: 126706 - DNA, 59 bp, Homo sapiens; identical to SEQ ID NO: 95070
  chr6:164173782-164173841
  Hypo

SEQ ID NO: 126707 - DNA, 155 bp, Homo sapiens; identical to SEQ ID NO: 95071
  chr6:164179641-164179796
  Hypo

SEQ ID NO: 126708 - DNA, 83 bp, Homo sapiens; identical to SEQ ID NO: 95072
  chr6:164182839-164182922
  Hypo

SEQ ID NO: 126709 - DNA, 85 bp, Homo sapiens; identical to SEQ ID NO: 95073
  chr6:164183688-164183773
  Hypo

SEQ ID NO: 126710 - DNA, 22 bp, Homo sapiens
  chr6:164196996-164197018
  Hypo
ctaaaagcgtcttctgacaaac

SEQ ID NO: 126711 - DNA, 207 bp, Homo sapiens; identical to SEQ ID NO: 95075
  chr6:164209872-164210079
  Hypo

SEQ ID NO: 126712 - DNA, 133 bp, Homo sapiens; identical to SEQ ID NO: 40964
  chr6:164228294-164228427
  Hypo

SEQ ID NO: 126713 - DNA, 195 bp, Homo sapiens; identical to SEQ ID NO: 95077
  chr6:164228682-164228877
  Hypo

SEQ ID NO: 126714 - DNA, 176 bp, Homo sapiens; identical to SEQ ID NO: 95078
  chr6:164241293-164241469
  Hypo

SEQ ID NO: 126715 - DNA, 30 bp, Homo sapiens; identical to SEQ ID NO: 40967
  chr6:164243378-164243408
  Hypo

SEQ ID NO: 126716 - DNA, 51 bp, Homo sapiens; identical to SEQ ID NO: 95080
  chr6:164245443-164245494
  Hypo

SEQ ID NO: 126717 - DNA, 21 bp, Homo sapiens
  chr6:164246122-164246143
  Hypo
ccgggccgatatggaatttct

SEQ ID NO: 126718 - DNA, 123 bp, Homo sapiens; identical to SEQ ID NO: 95082
  chr6:164255972-164256095
  Hypo

SEQ ID NO: 126719 - DNA, 68 bp, Homo sapiens; identical to SEQ ID NO: 40969
  chr6:164283216-164283284
  Hypo

SEQ ID NO: 126720 - DNA, 21 bp, Homo sapiens
  chr6:164284046-164284067
  Hypo
gaagagaaccagaaccgatgc

SEQ ID NO: 126721 - DNA, 38 bp, Homo sapiens; identical to SEQ ID NO: 95085
  chr6:164284509-164284547
  Hypo

SEQ ID NO: 126722 - DNA, 171 bp, Homo sapiens; identical to SEQ ID NO: 95086
  chr6:164288079-164288250
  Hypo

SEQ ID NO: 126723 - DNA, 76 bp, Homo sapiens; identical to SEQ ID NO: 95087
  chr6:164314367-164314443
  Hypo

SEQ ID NO: 126724 - DNA, 461 bp, Homo sapiens; identical to SEQ ID NO: 95088
  chr6:164322314-164322775
  Hypo

SEQ ID NO: 126725 - DNA, 86 bp, Homo sapiens; identical to SEQ ID NO: 40973
  chr6:164323845-164323931
  Hypo

SEQ ID NO: 126726 - DNA, 33 bp, Homo sapiens; identical to SEQ ID NO: 95090
  chr6:164329998-164330031
  Hypo

SEQ ID NO: 126727 - DNA, 108 bp, Homo sapiens; identical to SEQ ID NO: 40974
  chr6:164334224-164334332
  Hypo

SEQ ID NO: 126728 - DNA, 30 bp, Homo sapiens; identical to SEQ ID NO: 95092
  chr6:164340153-164340183
  Hypo

SEQ ID NO: 126729 - DNA, 30 bp, Homo sapiens; identical to SEQ ID NO: 95093
  chr6:164344488-164344518
  Hypo

SEQ ID NO: 126730 - DNA, 181 bp, Homo sapiens; identical to SEQ ID NO: 95094
  chr6:164384580-164384761
  Hypo

SEQ ID NO: 126731 - DNA, 65 bp, Homo sapiens; identical to SEQ ID NO: 95095
  chr6:164410701-164410766
  Hypo

SEQ ID NO: 126732 - DNA, 30 bp, Homo sapiens; identical to SEQ ID NO: 95096
  chr6:164441343-164441373
  Hypo

SEQ ID NO: 126733 - DNA, 184 bp, Homo sapiens; identical to SEQ ID NO: 95098
  chr6:164500295-164500479
  Hypo

SEQ ID NO: 126734 - DNA, 115 bp, Homo sapiens
  chr6:164520779-164520894
  Hypo
cgctggggcagatctcgccgcagggcagcaggcggtgctggtccagatactctggggagtctgcgcggtgtgcccggagcccctgggcgaacacggggcacgttgctgagaagca

SEQ ID NO: 126735 - DNA, 60 bp, Homo sapiens; identical to SEQ ID NO: 95099
  chr6:164565819-164565879
  Hypo

SEQ ID NO: 126736 - DNA, 49 bp, Homo sapiens; identical to SEQ ID NO: 95100
  chr6:164637238-164637287
  Hypo

SEQ ID NO: 126737 - DNA, 30 bp, Homo sapiens; identical to SEQ ID NO: 95101
  chr6:165416380-165416410
  Hypo

SEQ ID NO: 126738 - DNA, 61 bp, Homo sapiens; identical to SEQ ID NO: 95102
  chr6:165731354-165731415
  Hypo

SEQ ID NO: 126739 - DNA, 30 bp, Homo sapiens; identical to SEQ ID NO: 95103
  chr6:165746822-165746852
  Hypo

SEQ ID NO: 126740 - DNA, 198 bp, Homo sapiens; identical to SEQ ID NO: 95105
  chr6:166050958-166051156
  Hypo

SEQ ID NO: 126741 - DNA, 1514 bp, Homo sapiens
  chr6:166074010-166075524
  Hyper
cggggttgcaaggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggcacgaggggcggagaaggaggcggcaggtcccgctcgcaacgtccaagctcccgccgccctcccgagccgcccttcccccgagcgctcgcggagcctgggaaaccccggcgtccctgcgcggccgaacgctcccgcgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaaggtccatcttccatgtcggagccgaagagcagcgcgg

SEQ ID NO: 126742 - DNA, 964 bp, Homo sapiens; identical to SEQ ID NO: 95108
  chr6:166076095-166077059
  Hyper

SEQ ID NO: 126743 - DNA, 1101 bp, Homo sapiens
  chr6:166077335-166078436
  Hyper
acccccacccccttccgtagccatgaatccaggcagttgccactgaagggaaatgagccgcccaatgggcgctcagaactaggagccgccagaagtttggggaagttggagcgcaagagcgcacacagatgcacaggtgtccgcgttcgggcaggcacgcgcggcggggccaccatggcgcgctgggtccgaggaggggcggtggctgtgctgttccacggtggcacgggctgtccggactgcctggacgaggtcaccttccccggagtggagcacacgcgccaaagctcagctttcacgaagggcaaaacggtcacccaagcgccaggcgtgcgctacagtgcagcaactgggttgacccagggccctgggctcccggtgtgccccgggtcccggggccatttctcgccctccacgttttcttctttctatccagtttcacatgtttattttgaagcgtgctccagattcctcactagtcgatgctttccccgactcccatccaaactccccccaatggaaaataacacttttgtatttgcaccaagctgagcagttgggatgcaaaggacatgctggggctcccctcccccagtaaagtccacagacgtctccgcgattgccgggcagattctgagtgtcgcgtgtaacgggcatcagacttggcactcactaggtcagaatccctacatttgtggaagaagaaaatgattcctgtgactcttaccttaggggcgctgcccttgtttctgaattttttcggcaaagaaaaaaactgcaatggttgagccaggctgccggcagcctcccggcttgacgcttctccagccgtgcagagtccactccggttactttgctgcgagtccggagtttgtgctttcgcgactggaccaggcagcaagggtctgagggctgcccacacatttagggaagtcgagtttctcctcaagtgtttattgtttattcctttacacgcaaaattgtttctccttgtcatttaagtttctttatttgcattttggagttactaaatctatttttcagttccaagaaaatatacatttaacttgcccataagcccccttgcgggcgcaggagaca

SEQ ID NO: 126744 - DNA, 33 bp, Homo sapiens; identical to SEQ ID NO: 95111
  chr6:166122198-166122231
  Hypo

SEQ ID NO: 126745 - DNA, 47 bp, Homo sapiens; identical to SEQ ID NO: 95112
  chr6:166128567-166128614
  Hypo

SEQ ID NO: 126746 - DNA, 185 bp, Homo sapiens; identical to SEQ ID NO: 95113
  chr6:166217994-166218179
  Hyper

SEQ ID NO: 126747 - DNA, 274 bp, Homo sapiens; identical to SEQ ID NO: 95114
  chr6:166218546-166218820
  Hyper

SEQ ID NO: 126748 - DNA, 648 bp, Homo sapiens
  chr6:166267494-166268142
  Hyper
gtgggaagccaaggccgtgatgcggggcgtggtggtgagcaggctgcgctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtgcgttttggaaattgctgctgtgagccgcaagacgttcgcaggctctgctgcgagcccccaggacgtcccccggtgtccacctccgggcggctctcgcggccagacaaggagccctgaggggcggcctcaaggagcgcccaggccgctgagctcccagggcggcacagagggagcccgggggtccccagctctggcctcgccgtcttgtcttgctggaggtgaggggagcgggtggcgaaggtgcaggagc

SEQ ID NO: 126749 - DNA, 61 bp, Homo sapiens; identical to SEQ ID NO: 95116
  chr6:166298461-166298522
  Hyper

SEQ ID NO: 126750 - DNA, 156 bp, Homo sapiens; identical to SEQ ID NO: 95117
  chr6:166302038-166302194
  Hypo

SEQ ID NO: 126751 - DNA, 30 bp, Homo sapiens; identical to SEQ ID NO: 95118
  chr6:166314916-166314946
  Hypo

SEQ ID NO: 126752 - DNA, 111 bp, Homo sapiens; identical to SEQ ID NO: 95119
  chr6:166343020-166343131
  Hypo

SEQ ID NO: 126753 - DNA, 30 bp, Homo sapiens; identical to SEQ ID NO: 95120
  chr6:166344391-166344421
  Hypo

SEQ ID NO: 126754 - DNA, 115 bp, Homo sapiens; identical to SEQ ID NO: 95121
  chr6:166399418-166399533
  Hyper

SEQ ID NO: 126755 - DNA, 945 bp, Homo sapiens; identical to SEQ ID NO: 95122
  chr6:166400555-166401500
  Hyper

SEQ ID NO: 126756 - DNA, 793 bp, Homo sapiens
  chr6:166401934-166402727
  Hyper
ccccaacccgacccccgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggccaaaggcctgctctccccgttctccccaacacacaccaggggtcttttctgccccggagaagttgggacgcaaaacgtagggaactgcgctcagtctccgcaccacgaagagtcgagatggggaccgagaccagcacggacggtagcaacagagaggggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcccgttcccgaccctgggtgggaggaacttaaagggctgagttctgaggcgccaggcacagggcgcagcttcataaat

SEQ ID NO: 126757 - DNA, 158 bp, Homo sapiens; identical to SEQ ID NO: 95124
  chr6:166419898-166420056
  Hyper

SEQ ID NO: 126758 - DNA, 362 bp, Homo sapiens
  chr6:166421919-166422281
  Hyper
ggagatgcgcccaagcgggggcggaggagcgggtcgcgccgctgacattcgccaaggacaggatggggtgggcgcccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggggcgccggaggggtgggtcccgggacagaccagtgaccatccgcctcctgcgtagcgctgcccccaggagaggaaaacccatcggaggttgtgctgt

SEQ ID NO: 126759 - DNA, 42 bp, Homo sapiens; identical to SEQ ID NO: 95127
  chr6:166487228-166487270
  Hypo

SEQ ID NO: 126760 - DNA, 135 bp, Homo sapiens; identical to SEQ ID NO: 95128
  chr6:166571802-166571937
  Hypo

SEQ ID NO: 126761 - DNA, 3679 bp, Homo sapiens
  chr6:166579715-166583394
  Hyper
tttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgtgtcattgctttcacggaaggtgggagaaggtcggggctggcggggtggtccggactagtgggactcggggcgctttccccgcccggcccagcgccaagcggtgtcggcagcggttgttttattacctttcggtgagaacttacgcgaggagagcgaaggagaggtgacaatgagcaggaaatagttcagtggggtctctttaaacagtaacattcctcctaaaacgggagcccaggaagggggaaggaggcagaagctcccccttccaaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctggggaagccgaaggagggatccccgcccgggactcgagggatcgacccgcctcgcggtatgcggagggctgccaggagccagtcccggggaagggtgcctgccgcccgtgggggacagggctccttctctcccttctccaacttacaccgacgagtcaggaagccggagcgtctagtccctgtccgcatttctcagtgtcttttgatgtctgggatgcatggatattcccagggggctgacccgaggtggggaagtttccttctagaaagaggcaccaaaaggacctcatttgctcctgacgccggaccctcctgacacgccttcactggctcatcgggtcctgggctttgggggagagcgtggtgcgtgttactctccttactccgggtattaaaatgtctaagaggtcatcgctttggcccaaggcctcccgaggataagataaaagggaaaagtggaggggaggtgaaggaggaacgagggtgggtcccaggcaattgagggcctcggaaccctaggcacgggagcgaaacctctcctgcggcttcagggcaaaggagtcccgaaggctggatccctcccctgcgctcggacggcgtc

SEQ ID NO: 126762 - DNA, 42 bp, Homo sapiens; identical to SEQ ID NO: 95133
  chr6:166635577-166635619
  Hypo

SEQ ID NO: 126763 - DNA, 570 bp, Homo sapiens
  chr6:166666726-166667296
  Hyper
tcgaaaaaaaaagaagaggaaagaaaaagaaaaccagaacgagaaagtgcggccagcccgggctcaggagctgggtgggaaacaaagccgccagaaaatgacaagtaaacacgcagccgcgggaagccactgggcggagcgggcgctaatgagcgcgcagcggggccgccacgcccgcgcggacacggagcagcggcgcctttccctgcgactggctgtgtcgcctggagcccggcggccgccaccccagggagaaagctccggtgaggggagcagacgctgggacccgtggtctcgccctctgctctttcctggctggggacgggggtagctcccaggcaaaggccctccggggtctccgcccggggggccccacctgccttgtgacggctgagatgtgcgcgtcccacccactttccaaggcgcctttgaagtcgtttctcattaaaaaacaagctttttgaataaccaaatgttcctttggcgccctccaattttattttactgtaatctattgagttgtatttgtttttctgaatccgcttcctaggaaagcgccccctcccattt

SEQ ID NO: 126764 - DNA, 66 bp, Homo sapiens; identical to SEQ ID NO: 95137
  chr6:166667524-166667590
  Hyper

SEQ ID NO: 126765 - DNA, 188 bp, Homo sapiens; identical to SEQ ID NO: 95138
  chr6:166683768-166683956
  Hypo

SEQ ID NO: 126766 - DNA, 137 bp, Homo sapiens; identical to SEQ ID NO: 95139
  chr6:166711365-166711502
  Hypo

SEQ ID NO: 126767 - DNA, 278 bp, Homo sapiens; identical to SEQ ID NO: 95140
  chr6:166721166-166721444
  Hyper

SEQ ID NO: 126768 - DNA, 480 bp, Homo sapiens; identical to SEQ ID NO: 95141
  chr6:166721658-166722138
  Hyper

SEQ ID NO: 126769 - DNA, 30 bp, Homo sapiens; identical to SEQ ID NO: 95142
  chr6:166731737-166731767
  Hypo

SEQ ID NO: 126770 - DNA, 30 bp, Homo sapiens; identical to SEQ ID NO: 95143
  chr6:166825908-166825938
  Hypo

SEQ ID NO: 126771 - DNA, 32 bp, Homo sapiens; identical to SEQ ID NO: 40979
  chr6:166888304-166888336
  Hypo

SEQ ID NO: 126772 - DNA, 193 bp, Homo sapiens; identical to SEQ ID NO: 95145
  chr6:166891666-166891859
  Hypo

SEQ ID NO: 126773 - DNA, 238 bp, Homo sapiens; identical to SEQ ID NO: 95146
  chr6:166911041-166911279
  Hypo

SEQ ID NO: 126774 - DNA, 30 bp, Homo sapiens; identical to SEQ ID NO: 95147
  chr6:166914926-166914956
  Hypo

SEQ ID NO: 126775 - DNA, 33 bp, Homo sapiens; identical to SEQ ID NO: 95148
  chr6:166939005-166939038
  Hypo

SEQ ID NO: 126776 - DNA, 30 bp, Homo sapiens; identical to SEQ ID NO: 95149
  chr6:166943962-166943992
  Hypo

SEQ ID NO: 126777 - DNA, 166 bp, Homo sapiens; identical to SEQ ID NO: 95150
  chr6:166944346-166944512
  Hypo

SEQ ID NO: 126778 - DNA, 30 bp, Homo sapiens; identical to SEQ ID NO: 95151
  chr6:166946950-166946980
  Hypo

SEQ ID NO: 126779 - DNA, 30 bp, Homo sapiens; identical to SEQ ID NO: 40982
  chr6:166982961-166982991
  Hypo

SEQ ID NO: 126780 - DNA, 83 bp, Homo sapiens; identical to SEQ ID NO: 95153
  chr6:167038238-167038321
  Hypo

SEQ ID NO: 126781 - DNA, 30 bp, Homo sapiens; identical to SEQ ID NO: 95154
  chr6:167039728-167039758
  Hyper

SEQ ID NO: 126782 - DNA, 198 bp, Homo sapiens; identical to SEQ ID NO: 95155
  chr6:167040127-167040325
  Hyper

SEQ ID NO: 126783 - DNA, 94 bp, Homo sapiens; identical to SEQ ID NO: 95156
  chr6:167041860-167041954
  Hyper

SEQ ID NO: 126784 - DNA, 30 bp, Homo sapiens; identical to SEQ ID NO: 95157
  chr6:167045191-167045221
  Hypo

SEQ ID NO: 126785 - DNA, 124 bp, Homo sapiens; identical to SEQ ID NO: 95158
  chr6:167128131-167128255
  Hypo

SEQ ID NO: 126786 - DNA, 87 bp, Homo sapiens; identical to SEQ ID NO: 95159
  chr6:167129163-167129250
  Hypo

SEQ ID NO: 126787 - DNA, 30 bp, Homo sapiens; identical to SEQ ID NO: 95160
  chr6:167130073-167130103
  Hypo

SEQ ID NO: 126788 - DNA, 102 bp, Homo sapiens; identical to SEQ ID NO: 95161
  chr6:167136306-167136408
  Hypo

SEQ ID NO: 126789 - DNA, 308 bp, Homo sapiens; identical to SEQ ID NO: 95162
  chr6:167139142-167139450
  Hypo

SEQ ID NO: 126790 - DNA, 159 bp, Homo sapiens; identical to SEQ ID NO: 40985
  chr6:167140362-167140521
  Hypo

SEQ ID NO: 126791 - DNA, 42 bp, Homo sapiens; identical to SEQ ID NO: 95164
  chr6:167144433-167144475
  Hypo

SEQ ID NO: 126792 - DNA, 30 bp, Homo sapiens; identical to SEQ ID NO: 95165
  chr6:167250605-167250635
  Hypo

SEQ ID NO: 126793 - DNA, 363 bp, Homo sapiens; identical to SEQ ID NO: 95166
  chr6:167275668-167276031
  Hyper

SEQ ID NO: 126794 - DNA, 272 bp, Homo sapiens; identical to SEQ ID NO: 95167
  chr6:167276309-167276581
  Hyper

SEQ ID NO: 126795 - DNA, 30 bp, Homo sapiens; identical to SEQ ID NO: 95168
  chr6:167601185-167601215
  Hypo

SEQ ID NO: 126796 - DNA, 30 bp, Homo sapiens; identical to SEQ ID NO: 95169
  chr6:167753495-167753525
  Hypo

SEQ ID NO: 126797 - DNA, 194 bp, Homo sapiens; identical to SEQ ID NO: 95170
  chr6:167764951-167765145
  Hyper

SEQ ID NO: 126798 - DNA, 30 bp, Homo sapiens; identical to SEQ ID NO: 95171
  chr6:167833924-167833954
  Hypo

SEQ ID NO: 126799 - DNA, 324 bp, Homo sapiens; identical to SEQ ID NO: 95172
  chr6:167835015-167835339
  Hypo

SEQ ID NO: 126800 - DNA, 71 bp, Homo sapiens; identical to SEQ ID NO: 95173
  chr6:167836558-167836629
  Hypo

SEQ ID NO: 126801 - DNA, 32 bp, Homo sapiens; identical to SEQ ID NO: 95174
  chr6:167837812-167837844
  Hypo

SEQ ID NO: 126802 - DNA, 30 bp, Homo sapiens; identical to SEQ ID NO: 95175
  chr6:168122238-168122268
  Hypo

SEQ ID NO: 126803 - DNA, 152 bp, Homo sapiens; identical to SEQ ID NO: 95176
  chr6:168122617-168122769
  Hypo

SEQ ID NO: 126804 - DNA, 30 bp, Homo sapiens; identical to SEQ ID NO: 95177
  chr6:168375613-168375643
  Hypo

SEQ ID NO: 126805 - DNA, 191 bp, Homo sapiens; identical to SEQ ID NO: 95178
  chr6:168376093-168376284
  Hypo

SEQ ID NO: 126806 - DNA, 207 bp, Homo sapiens; identical to SEQ ID NO: 95179
  chr6:168377401-168377608
  Hypo

SEQ ID NO: 126807 - DNA, 33 bp, Homo sapiens; identical to SEQ ID NO: 40990
  chr6:168399961-168399994
  Hypo

SEQ ID NO: 126808 - DNA, 204 bp, Homo sapiens; identical to SEQ ID NO: 95181
  chr6:168453289-168453493
  Hypo

SEQ ID NO: 126809 - DNA, 36 bp, Homo sapiens; identical to SEQ ID NO: 95182
  chr6:168462485-168462521
  Hypo

SEQ ID NO: 126810 - DNA, 30 bp, Homo sapiens; identical to SEQ ID NO: 95183
  chr6:168479771-168479801
  Hypo

SEQ ID NO: 126811 - DNA, 274 bp, Homo sapiens
  chr6:168719798-168720072
  Hyper
gtaggcgcacatccacgcacggcggagcgcgggctgcagccccgggcagttttcagggtcctcacctgtgcgcttcacctctaggcacctgcgcgcggggcctccatgtccccctccttggagaccgaactgcattccattcaaatcccaaaggacgtcccctccatccatcagacacccccgtcccactaacacacagtcgctgccgaaggagcagcgcctgtggcccgcacacctcgcagccccgagtcccggcgcccggtccttaccagct

SEQ ID NO: 126812 - DNA, 58 bp, Homo sapiens; identical to SEQ ID NO: 95186
  chr6:168760650-168760708
  Hypo

SEQ ID NO: 126813 - DNA, 180 bp, Homo sapiens; identical to SEQ ID NO: 95187
  chr6:168771518-168771698
  Hypo

SEQ ID NO: 126814 - DNA, 1095 bp, Homo sapiens
  chr6:168841423-168842518
  Hyper
gtggatgaaaagtcccgctgggctgatcctgcgcggaccgggcctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgg

SEQ ID NO: 126815 - DNA, 401 bp, Homo sapiens
  chr6:168842858-168843259
  Hyper
caggcggcggctccccgctctgcggggcctctgggttcttcctcgtggcagggatgctgcgctcctgagcgcgagggtcaccgcggttgaccgctgtgtgtttttctttctgagctgtaacttctatgcgacagccttggcccggccaacgcacgcggtgtcaaacgaggagctatgtagagggggctgagccaagcccccgccggccaagccaacccgcggcggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaacgcctctggtggaca

SEQ ID NO: 126816 - DNA, 248 bp, Homo sapiens; identical to SEQ ID NO: 95192
  chr6:168858091-168858339
  Hypo

SEQ ID NO: 126817 - DNA, 177 bp, Homo sapiens; identical to SEQ ID NO: 95193
  chr6:168947622-168947799
  Hypo

SEQ ID NO: 126818 - DNA, 66 bp, Homo sapiens; identical to SEQ ID NO: 95194
  chr6:168983395-168983461
  Hypo

SEQ ID NO: 126819 - DNA, 128 bp, Homo sapiens; identical to SEQ ID NO: 95195
  chr6:168999540-168999668
  Hypo

SEQ ID NO: 126820 - DNA, 32 bp, Homo sapiens; identical to SEQ ID NO: 95196
  chr6:169067893-169067925
  Hypo

SEQ ID NO: 126821 - DNA, 30 bp, Homo sapiens; identical to SEQ ID NO: 95197
  chr6:169102398-169102428
  Hypo

SEQ ID NO: 126822 - DNA, 51 bp, Homo sapiens; identical to SEQ ID NO: 95198
  chr6:169105616-169105667
  Hypo

SEQ ID NO: 126823 - DNA, 41 bp, Homo sapiens; identical to SEQ ID NO: 95199
  chr6:169400235-169400276
  Hypo

SEQ ID NO: 126824 - DNA, 138 bp, Homo sapiens; identical to SEQ ID NO: 95200
  chr6:169462691-169462829
  Hypo

SEQ ID NO: 126825 - DNA, 165 bp, Homo sapiens; identical to SEQ ID NO: 95201
  chr6:169539538-169539703
  Hypo

SEQ ID NO: 126826 - DNA, 169 bp, Homo sapiens; identical to SEQ ID NO: 95202
  chr6:169562391-169562560
  Hypo

SEQ ID NO: 126827 - DNA, 177 bp, Homo sapiens; identical to SEQ ID NO: 95203
  chr6:169562792-169562969
  Hypo

SEQ ID NO: 126828 - DNA, 107 bp, Homo sapiens; identical to SEQ ID NO: 95204
  chr6:169567826-169567933
  Hypo

SEQ ID NO: 126829 - DNA, 30 bp, Homo sapiens; identical to SEQ ID NO: 95205
  chr6:169571409-169571439
  Hypo

SEQ ID NO: 126830 - DNA, 496 bp, Homo sapiens; identical to SEQ ID NO: 95206
  chr6:169632340-169632836
  Hypo

SEQ ID NO: 126831 - DNA, 39 bp, Homo sapiens; identical to SEQ ID NO: 95207
  chr6:169633129-169633168
  Hypo

SEQ ID NO: 126832 - DNA, 30 bp, Homo sapiens; identical to SEQ ID NO: 95208
  chr6:169634777-169634807
  Hypo

SEQ ID NO: 126833 - DNA, 118 bp, Homo sapiens; identical to SEQ ID NO: 95209
  chr6:169637173-169637291
  Hypo

SEQ ID NO: 126834 - DNA, 35 bp, Homo sapiens; identical to SEQ ID NO: 40999
  chr6:169637816-169637851
  Hypo

SEQ ID NO: 126835 - DNA, 42 bp, Homo sapiens; identical to SEQ ID NO: 95211
  chr6:169640567-169640609
  Hypo

SEQ ID NO: 126836 - DNA, 116 bp, Homo sapiens; identical to SEQ ID NO: 95212
  chr6:169641889-169642005
  Hypo

SEQ ID NO: 126837 - DNA, 454 bp, Homo sapiens; identical to SEQ ID NO: 95213
  chr6:169653638-169654092
  Hyper

SEQ ID NO: 126838 - DNA, 42 bp, Homo sapiens; identical to SEQ ID NO: 95214
  chr6:169713648-169713690
  Hypo

SEQ ID NO: 126839 - DNA, 48 bp, Homo sapiens; identical to SEQ ID NO: 95215
  chr6:169740765-169740813
  Hypo

SEQ ID NO: 126840 - DNA, 36 bp, Homo sapiens; identical to SEQ ID NO: 95216
  chr6:169852398-169852434
  Hypo

SEQ ID NO: 126841 - DNA, 30 bp, Homo sapiens; identical to SEQ ID NO: 41002
  chr6:170065367-170065397
  Hypo

SEQ ID NO: 126842 - DNA, 45 bp, Homo sapiens; identical to SEQ ID NO: 95218
  chr6:170091017-170091062
  Hypo

SEQ ID NO: 126843 - DNA, 30 bp, Homo sapiens; identical to SEQ ID NO: 41003
  chr6:170201723-170201753
  Hypo

SEQ ID NO: 126844 - DNA, 30 bp, Homo sapiens; identical to SEQ ID NO: 41004
  chr6:170240081-170240111
  Hypo

SEQ ID NO: 126845 - DNA, 30 bp, Homo sapiens; identical to SEQ ID NO: 95221
  chr6:170240765-170240795
  Hypo

SEQ ID NO: 126846 - DNA, 30 bp, Homo sapiens; identical to SEQ ID NO: 95222
  chr6:170249406-170249436
  Hypo

SEQ ID NO: 126847 - DNA, 50 bp, Homo sapiens; identical to SEQ ID NO: 95223
  chr6:170263200-170263250
  Hypo

SEQ ID NO: 126848 - DNA, 42 bp, Homo sapiens; identical to SEQ ID NO: 95224
  chr6:170264728-170264770
  Hypo

SEQ ID NO: 126849 - DNA, 139 bp, Homo sapiens; identical to SEQ ID NO: 95225
  chr6:170339404-170339543
  Hypo

SEQ ID NO: 126850 - DNA, 30 bp, Homo sapiens; identical to SEQ ID NO: 95226
  chr6:170343912-170343942
  Hypo

SEQ ID NO: 126851 - DNA, 30 bp, Homo sapiens; identical to SEQ ID NO: 41006
  chr6:170361487-170361517
  Hypo

SEQ ID NO: 126852 - DNA, 30 bp, Homo sapiens; identical to SEQ ID NO: 95228
  chr6:170365462-170365492
  Hypo

SEQ ID NO: 126853 - DNA, 30 bp, Homo sapiens; identical to SEQ ID NO: 41007
  chr6:170368767-170368797
  Hypo

SEQ ID NO: 126854 - DNA, 30 bp, Homo sapiens; identical to SEQ ID NO: 95230
  chr6:170371320-170371350
  Hypo

SEQ ID NO: 126855 - DNA, 30 bp, Homo sapiens; identical to SEQ ID NO: 95231
  chr6:170374015-170374045
  Hypo

SEQ ID NO: 126856 - DNA, 42 bp, Homo sapiens; identical to SEQ ID NO: 95232
  chr6:170392903-170392945
  Hypo

SEQ ID NO: 126857 - DNA, 323 bp, Homo sapiens; identical to SEQ ID NO: 95233
  chr6:170402281-170402604
  Hypo

SEQ ID NO: 126858 - DNA, 38 bp, Homo sapiens; identical to SEQ ID NO: 95234
  chr6:170408290-170408328
  Hypo

SEQ ID NO: 126859 - DNA, 32 bp, Homo sapiens; identical to SEQ ID NO: 95235
  chr6:170409702-170409734
  Hypo

SEQ ID NO: 126860 - DNA, 114 bp, Homo sapiens; identical to SEQ ID NO: 95236
  chr6:170413679-170413793
  Hypo

SEQ ID NO: 126861 - DNA, 138 bp, Homo sapiens; identical to SEQ ID NO: 95237
  chr6:170454062-170454200
  Hypo

SEQ ID NO: 126862 - DNA, 781 bp, Homo sapiens; identical to SEQ ID NO: 95238
  chr6:170474843-170475624
  Hypo

SEQ ID NO: 126863 - DNA, 48 bp, Homo sapiens; identical to SEQ ID NO: 95239
  chr6:170475958-170476006
  Hypo

SEQ ID NO: 126864 - DNA, 142 bp, Homo sapiens; identical to SEQ ID NO: 95240
  chr6:170493059-170493201
  Hypo

SEQ ID NO: 126865 - DNA, 126 bp, Homo sapiens; identical to SEQ ID NO: 95241
  chr6:170526716-170526842
  Hypo

SEQ ID NO: 126866 - DNA, 30 bp, Homo sapiens; identical to SEQ ID NO: 95242
  chr6:170538913-170538943
  Hypo

SEQ ID NO: 126867 - DNA, 142 bp, Homo sapiens; identical to SEQ ID NO: 95243
  chr6:170569776-170569918
  Hypo

SEQ ID NO: 126868 - DNA, 76 bp, Homo sapiens; identical to SEQ ID NO: 95244
  chr6:170579513-170579589
  Hypo

SEQ ID NO: 126869 - DNA, 30 bp, Homo sapiens; identical to SEQ ID NO: 95245
  chr6:170592975-170593005
  Hypo

SEQ ID NO: 126870 - DNA, 636 bp, Homo sapiens
  chr6:170598204-170598840
  Hyper
gggatgggcacgctccgggtggtagcggtcgcgctgcgcgggtaatcgcgccaccaacgcgtctaggagtcgggaaaccagaaccttcccacgtgaaggggcgcctctgactggagacctggcacagaggccggatacggaaatctcccgggcgcgctcggcctctcctcctcgccccagcgcggtcccctcctgcaggccgcggggccccggggcgaggtgtccgcgctgctgggctggagtcctggggccgccgctaggcagatcgcagcgcccacctgcgcctcgcggggtccccgaggtcccgccaccgagcgcccaaggcgggatcccagcgcgtcctgcagcccgcccagcttcagggccggcccggcgcgcgcaggtgcggcactcaccggccaggtgaagccgaaggggaagcggatggggttgctgaacgcggagtcggcgcccccgccgtcgggcagactgaaggagtcgacgcccagcacgggggtgacggcgctgccgtaggtgcagggcggctcgggggacacgctggcctggtagtgcttgaggcacacgcggaagaaggtccggcaggcgcacggcggtggccccgcgcccccgcggcagcagttgcggttccccagcagc

SEQ ID NO: 126871 - DNA, 420 bp, Homo sapiens
  chr6:170605520-170605940
  Hyper
gggccactgcgagggcggagggcggcgccagggccctcccggtggaccccagtcgccgtcgtgacggccccacgcagcctcgcgcccggccgccgcctcgtgcgggactcgtgcccgcattcccacctcaccgggtgcagccggcccggccccgggctgtgcgaggcgacggcgcacacctcggagccctgggggccggggtcggcgggcggggccggggcgcgccctttgtgcgctcttagcggaaaccgcgcgttcccagaggagcgcggcccgccgagaccccggatcccgacgccaggaggtgctgcaggagcccgcgcggggtgggggtctccggcccaggcccctcggtacgggccccctgcggccgccaccctccgcctccgcgcggcggctcctttccggctgcatccgggg

SEQ ID NO: 126872 - DNA, 45 bp, Homo sapiens; identical to SEQ ID NO: 95250
  chr6:170757555-170757600
  Hypo

SEQ ID NO: 126873 - DNA, 87 bp, Homo sapiens; identical to SEQ ID NO: 95252
  chr6:170921658-170921745
  Hyper

SEQ ID NO: 126874 - DNA, 30 bp, Homo sapiens; identical to SEQ ID NO: 98159
  chr7:88719-88749
  Hypo

SEQ ID NO: 126875 - DNA, 30 bp, Homo sapiens; identical to SEQ ID NO: 96249
  chr7:121074-121104
  Hypo

SEQ ID NO: 126876 - DNA, 167 bp, Homo sapiens; identical to SEQ ID NO: 41015
  chr7:131076-131243
  Hypo

SEQ ID NO: 126877 - DNA, 110 bp, Homo sapiens; identical to SEQ ID NO: 96576
  chr7:149110-149220
  Hyper

SEQ ID NO: 126878 - DNA, 193 bp, Homo sapiens; identical to SEQ ID NO: 97098
  chr7:171314-171507
  Hypo

SEQ ID NO: 126879 - DNA, 30 bp, Homo sapiens; identical to SEQ ID NO: 97105
  chr7:173466-173496
  Hypo

SEQ ID NO: 126880 - DNA, 51 bp, Homo sapiens; identical to SEQ ID NO: 97129
  chr7:186628-186679
  Hypo

SEQ ID NO: 126881 - DNA, 90 bp, Homo sapiens; identical to SEQ ID NO: 97147
  chr7:191827-191917
  Hyper

SEQ ID NO: 126882 - DNA, 184 bp, Homo sapiens; identical to SEQ ID NO: 97152
  chr7:192430-192614
  Hyper

SEQ ID NO: 126883 - DNA, 125 bp, Homo sapiens; identical to SEQ ID NO: 97153
  chr7:192976-193101
  Hyper

SEQ ID NO: 126884 - DNA, 96 bp, Homo sapiens; identical to SEQ ID NO: 97155
  chr7:193612-193708
  Hyper

SEQ ID NO: 126885 - DNA, 39 bp, Homo sapiens; identical to SEQ ID NO: 97156
  chr7:193984-194023
  Hyper

SEQ ID NO: 126886 - DNA, 30 bp, Homo sapiens; identical to SEQ ID NO: 97188
  chr7:208441-208471
  Hypo

SEQ ID NO: 126887 - DNA, 50 bp, Homo sapiens; identical to SEQ ID NO: 97378
  chr7:288278-288328
  Hypo

SEQ ID NO: 126888 - DNA, 69 bp, Homo sapiens; identical to SEQ ID NO: 97394
  chr7:294045-294114
  Hypo

SEQ ID NO: 126889 - DNA, 67 bp, Homo sapiens; identical to SEQ ID NO: 97408
  chr7:297499-297566
  Hypo

SEQ ID NO: 126890 - DNA, 114 bp, Homo sapiens; identical to SEQ ID NO: 97429
  chr7:306957-307071
  Hypo

SEQ ID NO: 126891 - DNA, 46 bp, Homo sapiens; identical to SEQ ID NO: 97450
  chr7:312592-312638
  Hypo

SEQ ID NO: 126892 - DNA, 216 bp, Homo sapiens; identical to SEQ ID NO: 97461
  chr7:322599-322815
  Hypo

SEQ ID NO: 126893 - DNA, 160 bp, Homo sapiens; identical to SEQ ID NO: 97471
  chr7:328246-328406
  Hypo

SEQ ID NO: 126894 - DNA, 39 bp, Homo sapiens; identical to SEQ ID NO: 97473
  chr7:328586-328625
  Hypo

SEQ ID NO: 126895 - DNA, 309 bp, Homo sapiens
  chr7:329622-329931
  Hyper
cccggaaagcaccaccgagtctcaggcgcgcccagggcgcacgggaccggggctcacggcaccggggcgctccgaggagacttccgccagtgcagggagcctgcgaggacaccccaagctgcctccagggacggggacggagcgagccctgccctgagcgccccaggaagggagccgggtagggggggccgccccgcccgtcggaccacccagcgcgccgcctcctcctccctccccccgcggcggtcagagggtcacccagacgccccacaccgctcccctcggccgctttaccggtggctggggcct

SEQ ID NO: 126896 - DNA, 549 bp, Homo sapiens
  chr7:330320-330869
  Hyper
gggacgaaggaagggcgggggagctttcttctctccggcggcggagctcagagaaaggacgcatttgtccctactttggggagagccagggagggttcttggcctcgcggggaggggcctccgcaggtcgggaaagagcttctggggtctgggtggcgccggggaccgcgagctgcggggacactttccccaacaccgcctcgctcctccgcctctgcgccccacggcgtcctgcgggatggggggaaggacggggggctgcccggtggagaccccgcctgacccccgggctccgcagctacatcgccttgatcgccatggccattcagcagagccccgcggggagggtgaccctgtccggcatctacgacttcatcatgcgcaaattcccctattaccgcgccaaccagcgcgcctggcagaactccatccgccacaacctgtccctcaacagctgcttcgtcaaggtgagcgccgcccccgacgggccccgggtgtcccagcgtggcgacacctgcgccagggcctcggtggcggggaagggagggc

SEQ ID NO: 126897 - DNA, 30 bp, Homo sapiens; identical to SEQ ID NO: 97487
  chr7:341655-341685
  Hypo

SEQ ID NO: 126898 - DNA, 313 bp, Homo sapiens; identical to SEQ ID NO: 97488
  chr7:345295-345608
  Hypo

SEQ ID NO: 126899 - DNA, 30 bp, Homo sapiens; identical to SEQ ID NO: 97509
  chr7:355057-355087
  Hypo

SEQ ID NO: 126900 - DNA, 272 bp, Homo sapiens; identical to SEQ ID NO: 97516
  chr7:369844-370116
  Hypo

SEQ ID NO: 126901 - DNA, 32 bp, Homo sapiens; identical to SEQ ID NO: 97552
  chr7:380766-380798
  Hypo

SEQ ID NO: 126902 - DNA, 30 bp, Homo sapiens; identical to SEQ ID NO: 41021
  chr7:381568-381598
  Hypo

SEQ ID NO: 126903 - DNA, 34 bp, Homo sapiens; identical to SEQ ID NO: 97563
  chr7:387990-388024
  Hypo

SEQ ID NO: 126904 - DNA, 239 bp, Homo sapiens; identical to SEQ ID NO: 97564
  chr7:389663-389902
  Hypo

SEQ ID NO: 126905 - DNA, 179 bp, Homo sapiens; identical to SEQ ID NO: 41023
  chr7:409602-409781
  Hypo

SEQ ID NO: 126906 - DNA, 459 bp, Homo sapiens; identical to SEQ ID NO: 97588
  chr7:409986-410445
  Hypo

SEQ ID NO: 126907 - DNA, 30 bp, Homo sapiens; identical to SEQ ID NO: 97593
  chr7:414915-414945
  Hypo

SEQ ID NO: 126908 - DNA, 132 bp, Homo sapiens; identical to SEQ ID NO: 97625
  chr7:430257-430389
  Hypo

SEQ ID NO: 126909 - DNA, 397 bp, Homo sapiens; identical to SEQ ID NO: 97627
  chr7:431386-431783
  Hypo

SEQ ID NO: 126910 - DNA, 109 bp, Homo sapiens; identical to SEQ ID NO: 97681
  chr7:450465-450574
  Hypo

SEQ ID NO: 126911 - DNA, 30 bp, Homo sapiens; identical to SEQ ID NO: 97688
  chr7:453753-453783
  Hypo

SEQ ID NO: 126912 - DNA, 30 bp, Homo sapiens; identical to SEQ ID NO: 97699
  chr7:466547-466577
  Hypo

SEQ ID NO: 126913 - DNA, 37 bp, Homo sapiens; identical to SEQ ID NO: 97700
  chr7:471149-471186
  Hypo

SEQ ID NO: 126914 - DNA, 53 bp, Homo sapiens; identical to SEQ ID NO: 97701
  chr7:472685-472738
  Hypo

SEQ ID NO: 126915 - DNA, 119 bp, Homo sapiens; identical to SEQ ID NO: 97712
  chr7:476416-476535
  Hypo

SEQ ID NO: 126916 - DNA, 49 bp, Homo sapiens; identical to SEQ ID NO: 97746
  chr7:494963-495012
  Hypo

SEQ ID NO: 126917 - DNA, 167 bp, Homo sapiens; identical to SEQ ID NO: 41029
  chr7:497742-497909
  Hypo

SEQ ID NO: 126918 - DNA, 100 bp, Homo sapiens; identical to SEQ ID NO: 97763
  chr7:502263-502363
  Hypo

SEQ ID NO: 126919 - DNA, 392 bp, Homo sapiens; identical to SEQ ID NO: 97768
  chr7:502708-503100
  Hypo

SEQ ID NO: 126920 - DNA, 354 bp, Homo sapiens; identical to SEQ ID NO: 97778
  chr7:503676-504030
  Hypo

SEQ ID NO: 126921 - DNA, 125 bp, Homo sapiens; identical to SEQ ID NO: 97807
  chr7:532811-532936
  Hypo

SEQ ID NO: 126922 - DNA, 37 bp, Homo sapiens; identical to SEQ ID NO: 97813
  chr7:543015-543052
  Hypo

SEQ ID NO: 126923 - DNA, 112 bp, Homo sapiens; identical to SEQ ID NO: 41034
  chr7:551572-551684
  Hypo

SEQ ID NO: 126924 - DNA, 66 bp, Homo sapiens; identical to SEQ ID NO: 97837
  chr7:551953-552019
  Hypo

SEQ ID NO: 126925 - DNA, 142 bp, Homo sapiens; identical to SEQ ID NO: 97840
  chr7:552953-553095
  Hypo

SEQ ID NO: 126926 - DNA, 30 bp, Homo sapiens; identical to SEQ ID NO: 97846
  chr7:556686-556716
  Hyper

SEQ ID NO: 126927 - DNA, 127 bp, Homo sapiens; identical to SEQ ID NO: 97847
  chr7:557093-557220
  Hyper

SEQ ID NO: 126928 - DNA, 161 bp, Homo sapiens; identical to SEQ ID NO: 97852
  chr7:560181-560342
  Hyper

SEQ ID NO: 126929 - DNA, 40 bp, Homo sapiens; identical to SEQ ID NO: 97855
  chr7:560554-560594
  Hyper

SEQ ID NO: 126930 - DNA, 317 bp, Homo sapiens; identical to SEQ ID NO: 97856
  chr7:560928-561245
  Hyper

SEQ ID NO: 126931 - DNA, 211 bp, Homo sapiens; identical to SEQ ID NO: 97865
  chr7:562619-562830
  Hyper

SEQ ID NO: 126932 - DNA, 30 bp, Homo sapiens; identical to SEQ ID NO: 97874
  chr7:572406-572436
  Hypo

SEQ ID NO: 126933 - DNA, 126 bp, Homo sapiens; identical to SEQ ID NO: 41036
  chr7:578922-579048
  Hypo

SEQ ID NO: 126934 - DNA, 68 bp, Homo sapiens; identical to SEQ ID NO: 97891
  chr7:612677-612745
  Hypo

SEQ ID NO: 126935 - DNA, 30 bp, Homo sapiens; identical to SEQ ID NO: 98067
  chr7:746995-747025
  Hypo

SEQ ID NO: 126936 - DNA, 718 bp, Homo sapiens
  chr7:751761-752479
  Hyper
aggccggcaccgcaccgcggggcgcaggaccccagccccccgccacgccgcccccggagtgcccagaccgccgggaaggcgcccacccagagaccccgcgccccccgccccaaacccggcctcagcgccggcgaggaccctcccgggacccctgaccgggagccccaggcccggccccgccccgcgcgccccactcccggcggggccgaacccttccaaatgtccgcatccccggggggcctcccaggcccggggctcccggcgcagaccccagcccggccccgcgtacctggatgcgcggcgcccgaggccaggaggcggctgcgcggggacgcggggcgcggggacggctggcgagcgagcgagcgggtccccgcactgcagcggcgccgccctccacgcccgcccccgcgccgcgcgcagctgctgcacccccaacgccgcccgcgcgggcctgcagcccgtctccccccgaccgcctccccgcggggcccccaaccccggcccccacccccggctctccccgcccccgccccatcccccaccggcgcaggttcaggccatcgctgccaggaccccccgctgtcgccgccccccgccccctccactcagactctgagtcgcccactccagccggtgcaggccgcggggccgcctctgatggcctgggcaccccccactcccgccccgttcacgaccaccgcggctgcctgagctg

SEQ ID NO: 126937 - DNA, 368 bp, Homo sapiens; identical to SEQ ID NO: 98100
  chr7:803247-803615
  Hypo

SEQ ID NO: 126938 - DNA, 49 bp, Homo sapiens; identical to SEQ ID NO: 98103
  chr7:808528-808577
  Hypo

SEQ ID NO: 126939 - DNA, 30 bp, Homo sapiens; identical to SEQ ID NO: 98104
  chr7:808818-808848
  Hypo

SEQ ID NO: 126940 - DNA, 298 bp, Homo sapiens; identical to SEQ ID NO: 98108
  chr7:819400-819698
  Hypo

SEQ ID NO: 126941 - DNA, 570 bp, Homo sapiens; identical to SEQ ID NO: 98115
  chr7:834303-834873
  Hypo

SEQ ID NO: 126942 - DNA, 207 bp, Homo sapiens; identical to SEQ ID NO: 98136
  chr7:852590-852797
  Hyper

SEQ ID NO: 126943 - DNA, 30 bp, Homo sapiens; identical to SEQ ID NO: 41041
  chr7:907656-907686
  Hypo

SEQ ID NO: 126944 - DNA, 328 bp, Homo sapiens
  chr7:915058-915386
  Hypo
ccctgtaaatccaacggaggagtcttcggaccgaacggcgaaccgccttcaaaccccaattcttacagccaagccgttcccaaccctgcacggctagggctgggcctcaggccccgtttctaactctgactggggtttggaccccgtttccgcagcctgacagggctggaagctctaggccgacccagttcccccttccagcaggacccgatcctggaggagtgagccgtccacccaggcacagccgcaggtccccagccacggccagggaaggaccgcaggtggcctttcaaagaggaggaacgcccctcagcgatcctaagaggtt

SEQ ID NO: 126945 - DNA, 62 bp, Homo sapiens; identical to SEQ ID NO: 98181
  chr7:920918-920980
  Hypo

SEQ ID NO: 126946 - DNA, 29 bp, Homo sapiens
  chr7:933292-933321
  Hypo
gttgggcgcaggcgcggtggtttgtgcag

SEQ ID NO: 126947 - DNA, 396 bp, Homo sapiens; identical to SEQ ID NO: 98208
  chr7:959576-959972
  Hypo

SEQ ID NO: 126948 - DNA, 37 bp, Homo sapiens; identical to SEQ ID NO: 98209
  chr7:965972-966009
  Hypo

SEQ ID NO: 126949 - DNA, 221 bp, Homo sapiens; identical to SEQ ID NO: 98239
  chr7:966840-967061
  Hypo

SEQ ID NO: 126950 - DNA, 30 bp, Homo sapiens; identical to SEQ ID NO: 98270
  chr7:978819-978849
  Hypo

SEQ ID NO: 126951 - DNA, 102 bp, Homo sapiens; identical to SEQ ID NO: 98283
  chr7:986234-986336
  Hypo

SEQ ID NO: 126952 - DNA, 95 bp, Homo sapiens; identical to SEQ ID NO: 98300
  chr7:994535-994630
  Hyper

SEQ ID NO: 126953 - DNA, 30 bp, Homo sapiens; identical to SEQ ID NO: 98315
  chr7:998684-998714
  Hypo

SEQ ID NO: 126954 - DNA, 30 bp, Homo sapiens; identical to SEQ ID NO: 96069
  chr7:1006918-1006948
  Hypo

SEQ ID NO: 126955 - DNA, 30 bp, Homo sapiens; identical to SEQ ID NO: 96125
  chr7:1019055-1019085
  Hypo

SEQ ID NO: 126956 - DNA, 212 bp, Homo sapiens; identical to SEQ ID NO: 96129
  chr7:1022042-1022254
  Hypo

SEQ ID NO: 126957 - DNA, 79 bp, Homo sapiens; identical to SEQ ID NO: 96131
  chr7:1022888-1022967
  Hypo

SEQ ID NO: 126958 - DNA, 52 bp, Homo sapiens; identical to SEQ ID NO: 96132
  chr7:1023349-1023401
  Hypo

SEQ ID NO: 126959 - DNA, 624 bp, Homo sapiens; identical to SEQ ID NO: 96133
  chr7:1026795-1027419
  Hypo

SEQ ID NO: 126960 - DNA, 328 bp, Homo sapiens; identical to SEQ ID NO: 96137
  chr7:1030000-1030328
  Hypo

SEQ ID NO: 126961 - DNA, 182 bp, Homo sapiens; identical to SEQ ID NO: 96139
  chr7:1031815-1031997
  Hypo

SEQ ID NO: 126962 - DNA, 85 bp, Homo sapiens; identical to SEQ ID NO: 96145
  chr7:1037221-1037306
  Hypo

SEQ ID NO: 126963 - DNA, 252 bp, Homo sapiens; identical to SEQ ID NO: 41054
  chr7:1054444-1054696
  Hypo

SEQ ID NO: 126964 - DNA, 405 bp, Homo sapiens; identical to SEQ ID NO: 96167
  chr7:1065987-1066392
  Hypo

SEQ ID NO: 126965 - DNA, 30 bp, Homo sapiens; identical to SEQ ID NO: 96185
  chr7:1071811-1071841
  Hypo

SEQ ID NO: 126966 - DNA, 120 bp, Homo sapiens; identical to SEQ ID NO: 96200
  chr7:1086199-1086319
  Hypo

SEQ ID NO: 126967 - DNA, 279 bp, Homo sapiens; identical to SEQ ID NO: 96202
  chr7:1105515-1105794
  Hyper

SEQ ID NO: 126968 - DNA, 30 bp, Homo sapiens; identical to SEQ ID NO: 41057
  chr7:1115722-1115752
  Hypo

SEQ ID NO: 126969 - DNA, 331 bp, Homo sapiens; identical to SEQ ID NO: 96211
  chr7:1126502-1126833
  Hyper

SEQ ID NO: 126970 - DNA, 30 bp, Homo sapiens; identical to SEQ ID NO: 96221
  chr7:1139445-1139475
  Hypo

SEQ ID NO: 126971 - DNA, 155 bp, Homo sapiens; identical to SEQ ID NO: 96222
  chr7:1140555-1140710
  Hypo

SEQ ID NO: 126972 - DNA, 33 bp, Homo sapiens; identical to SEQ ID NO: 96250
  chr7:1212360-1212393
  Hypo

SEQ ID NO: 126973 - DNA, 30 bp, Homo sapiens; identical to SEQ ID NO: 96277
  chr7:1220695-1220725
  Hypo

SEQ ID NO: 126974 - DNA, 93 bp, Homo sapiens; identical to SEQ ID NO: 96278
  chr7:1225133-1225226
  Hypo

SEQ ID NO: 126975 - DNA, 30 bp, Homo sapiens; identical to SEQ ID NO: 96289
  chr7:1252449-1252479
  Hypo

SEQ ID NO: 126976 - DNA, 634 bp, Homo sapiens
  chr7:1263639-1264273
  Hyper
gcgcgccctgaggttcggccgctgcgtggccttctccgggaggtggggggaatccgaagaggtcccaccccaggttcggttcccggcttcctggtctttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 126977 - DNA, 490 bp, Homo sapiens; identical to SEQ ID NO: 96294
  chr7:1265078-1265568
  Hyper

SEQ ID NO: 126978 - DNA, 611 bp, Homo sapiens
  chr7:1269197-1269808
  Hyper
cgctccggccgcccccgacccggacccggactccgggcccccagctgggcccaagcgcaggaggccggtcctcacggtgcgcccgggaagggaagggccgagcggcctggagctgccagaggccgcggcccgggcgggggaaggggcaggcggaaggcgggccccggaggtctccggctgggccgggcgcgcgcgcctgggccctttgtctcgcgcggccgtcgggcccggggccccagccctgtgcgctcggggcgaggaggttcccggccggccgcagccccgagccgaggcgggcgcggaggatgagggggggtttaggatgcggccccgcgacccccgtccccctggaccgcgggctggaccgggccggggcgcgtccggcagcgctgagaccccccaccccgaatcaaagtagcggcggctgcgggggcggcgggtgggtgggggggagccgaggaacacggcgaggcgagcggcgtcctgaatgcgagtcgtgtgcgtcttattatcaagttaattaaagctagcatctgacaatgtcactcggctgtagaaaaagggatttaaatgcagcgtctcccaggaccgcgtgtcgagggctgcttccc

SEQ ID NO: 126979 - DNA, 674 bp, Homo sapiens; identical to SEQ ID NO: 96301
  chr7:1270100-1270774
  Hyper

SEQ ID NO: 126980 - DNA, 123 bp, Homo sapiens; identical to SEQ ID NO: 96303
  chr7:1271038-1271161
  Hyper

SEQ ID NO: 126981 - DNA, 1657 bp, Homo sapiens
  chr7:1272298-1273955
  Hyper
ccctccggctccccccgcccccagcccgtcttgttgtgacagttcctgatactgtttattgaggtgcatgtcaggtataattagcaatcgatatggaaaacgtttccctgcacccagcacgcctctgacgtcagagccgattagcgcttcttattggtcccaaattccccgggccgcggctaattatcgggagcttgatgttgataagtaaagcgccggagtgcgggcgaagcatgtgtggggctccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcggctgggggcgggggccctggtccggccgaggcgctggggggcccggggctggcgaaggagagccggctcctaggcggccgtctctgcgcccccccccccggatccaggcggccagcgggtagcgggagggaggggtgggggtcgggcctgggccggtggctgagccgcgctgcgtcctgtgactgcccgcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtaaagacccggcgtcgctcccggatctgccatccggaccccaggctctgggcgcgccgggacgcctttgttccaggtggcgagatatcgtccccttgccgcgggcccgcttcgcgctcgcctgctggggaagagtggaggggtgggggttctggggctcggcccctcacggacagcggggtgggtaactgccccccaaaagcctgggcggcttgagaagggccggcggcagcacccgagtcaccagaacagcggctgcgtccgaaccgggaagcggcgtggtgggttggcggaggccgggccaagtgaggtctccaggcaggggcgaggaggggaggaggggccggcttggctccgacccggaggagagagggaaggggacccccccccgcccccgcaccgcctcaaccttccgcgcgaggctctgtcacccagcctggagcgaacgagtctgtttaccttgcgcctgcaaaatattcagatggaaacatgtatttattcatcgctttgcagaagggaacagctgaggaaggggaggcagaagcttaaacagttaacacattgagaaagtgggagaaaaaaaggtgtctgaatttttaataataaccccggtctcatcttttt

SEQ ID NO: 126982 - DNA, 760 bp, Homo sapiens
  chr7:1274432-1275192
  Hyper
cgttgggggagggctcggcttcatgctggagacctccccatggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccggacgagaagcacccatatttcccttcaagggattccgcccccacccccgaaatgtgggctttgacacagtctccaaggggccgaagacaggtgtggagggcggctgtggctcagcggtccaacggcaggatggtcagcgccaggccgggcgggctgcttagaacacgagccgtgagcggccaggaagggtgaacaggggccttgctctctagcctccggaccaggaacccgacgctctccgtccggggccagaccggccccccaagtaa

SEQ ID NO: 126983 - DNA, 1024 bp, Homo sapiens
  chr7:1275543-1276567
  Hyper
actcgcacccgaccacgtgcagcggcgagcccatggacccggaggagatcgcgcgcaaggagctggagaagatggagaagaagaagcgcaagcacgagaagaagctgctgaagagccagggccgccacttgcactcgcccggcggcctgtccctgcacagcgcgcccagctccgacagcgacagcggcggcggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggtcgccctgcggacaaggacgcggcctcgtgcgggccaggggccgctgtggcggcggtggagcgcggcgccgcggggctgcccaaggccagcccattcagcgtggagagcctcctgtccgactcgccgccgcgccggaaagccgcttccaacgccgccgccgccgccgccgcggggctggacttcgcgcccgggctgccgtgcgcgccgcggaccctgatcggcaagggccacttcctcctctaccccatcacgcagccgctcggcttcctggtgccgcaggccgcgctcaagggcggcgcgggcctggagccggcgcccaaggacgcgccgcccgcgcccgccgtgccgcccgcgccgcctgcccaggccagtttcggggccttctcggggcccggcggcgccccggactcggccttcgcgcgtcgcagccccgacgccgtcgcctccccgggggccccagccccggccccggcgcctttccgggacctcgcctcggcagcggctaccgagggcggcggcggggactgcgcggacgcggggaccgccggccccgcgcccccgccgcccgcgccgtcgcccaggcccggccctcggcctcccagccccgccgaggagccggccacctgcggggttcccgagcctggcgcggc

SEQ ID NO: 126984 - DNA, 567 bp, Homo sapiens; identical to SEQ ID NO: 96318
  chr7:1276989-1277556
  Hyper

SEQ ID NO: 126985 - DNA, 151 bp, Homo sapiens; identical to SEQ ID NO: 96323
  chr7:1277825-1277976
  Hyper

SEQ ID NO: 126986 - DNA, 234 bp, Homo sapiens; identical to SEQ ID NO: 96326
  chr7:1278288-1278522
  Hyper

SEQ ID NO: 126987 - DNA, 30 bp, Homo sapiens; identical to SEQ ID NO: 96330
  chr7:1279210-1279240
  Hyper

SEQ ID NO: 126988 - DNA, 200 bp, Homo sapiens; identical to SEQ ID NO: 96332
  chr7:1279875-1280075
  Hyper

SEQ ID NO: 126989 - DNA, 1250 bp, Homo sapiens; identical to SEQ ID NO: 96339
  chr7:1280349-1281599
  Hyper

SEQ ID NO: 126990 - DNA, 331 bp, Homo sapiens; identical to SEQ ID NO: 96343
  chr7:1281819-1282150
  Hyper

SEQ ID NO: 126991 - DNA, 175 bp, Homo sapiens; identical to SEQ ID NO: 96344
  chr7:1282506-1282681
  Hyper

SEQ ID NO: 126992 - DNA, 315 bp, Homo sapiens; identical to SEQ ID NO: 96348
  chr7:1283626-1283941
  Hyper

SEQ ID NO: 126993 - DNA, 47 bp, Homo sapiens; identical to SEQ ID NO: 96349
  chr7:1284177-1284224
  Hyper

SEQ ID NO: 126994 - DNA, 393 bp, Homo sapiens
  chr7:1286007-1286400
  Hyper
tttgttcttgttatccgtgataattgcgaagttcagcctctcggaattgggccggcctggtgcctccagcgccgggcagggcgggcagaggccgggctgggaggcggaggctccgctgctccccttttttcccgttggaggcgatgtgtcgggtccggacacgacgtggagaggccaccagtccggtcctggggcggcggcggcctacagggccgggtcttccttctgcagatgccggttcgagccgcggcccgatcccgatcccgggaagaaacgctccgtggctcgcccagggttaagagccgcggtgacaacccgtttttgtttgagaagcggtgggtggaagccacgaatcccacacgacatctggggaccaaacgcccagagtctgga

SEQ ID NO: 126995 - DNA, 716 bp, Homo sapiens
  chr7:1286670-1287386
  Hyper
acaaaagagtaactccggagaattagagaaaaaacccacgcaacaacaacacgagtcgggggcggggtgagcgctccggagaggcgctggtggggcggcggggcggggggtgctccgagccgagcagcccgacggacgcacccaggccagggctgcggagacccccgggcccgcgtgggagcagcgcgcggtccctccccaggaggcggtggaggccgaagggagtcgccgggtacccggctcaggccgtgtctgagcgccagggatgcgcagaaatgggagcctggccgcgcctctgcagcggccttggaggagcctctggagcgggccccgcgggcgcgtggggtgggacctgctggagacccgcaggcggcggcggccaagcagggtcaggcggttggcaccacaggtcgcgccctcggctgcagtcggggcagctccagggggccgcgtacctcccgcttcacggctacgcgtgggggcggctccgtcctggcctcaccagcctccccggagcccctgccggtccccagcctgggggctcaggggtcccgttgggcgtgtgtcccgcccgggccccggtgtggggggcgcgcagtcctcagggccgcctccctcccgcccccagcacagcgccccccagctctcagccggtccttgcggccgcgggatcccagccccagcagcgggaaactgaggcccgcagcaccgatgcg

SEQ ID NO: 126996 - DNA, 35 bp, Homo sapiens; identical to SEQ ID NO: 96373
  chr7:1287623-1287658
  Hyper

SEQ ID NO: 126997 - DNA, 196 bp, Homo sapiens; identical to SEQ ID NO: 96375
  chr7:1288109-1288305
  Hyper

SEQ ID NO: 126998 - DNA, 301 bp, Homo sapiens; identical to SEQ ID NO: 96378
  chr7:1288552-1288853
  Hyper

SEQ ID NO: 126999 - DNA, 242 bp, Homo sapiens; identical to SEQ ID NO: 96379
  chr7:1289320-1289562
  Hyper

SEQ ID NO: 127000 - DNA, 143 bp, Homo sapiens; identical to SEQ ID NO: 96399
  chr7:1303425-1303568
  Hypo

SEQ ID NO: 127001 - DNA, 248 bp, Homo sapiens; identical to SEQ ID NO: 96400
  chr7:1308287-1308535
  Hypo

SEQ ID NO: 127002 - DNA, 185 bp, Homo sapiens; identical to SEQ ID NO: 96401
  chr7:1309947-1310132
  Hypo

SEQ ID NO: 127003 - DNA, 30 bp, Homo sapiens; identical to SEQ ID NO: 41060
  chr7:1313980-1314010
  Hypo

SEQ ID NO: 127004 - DNA, 143 bp, Homo sapiens; identical to SEQ ID NO: 96412
  chr7:1315844-1315987
  Hypo

SEQ ID NO: 127005 - DNA, 30 bp, Homo sapiens; identical to SEQ ID NO: 41062
  chr7:1318952-1318982
  Hypo

SEQ ID NO: 127006 - DNA, 34 bp, Homo sapiens; identical to SEQ ID NO: 96424
  chr7:1325238-1325272
  Hypo

SEQ ID NO: 127007 - DNA, 430 bp, Homo sapiens; identical to SEQ ID NO: 96425
  chr7:1325577-1326007
  Hypo

SEQ ID NO: 127008 - DNA, 121 bp, Homo sapiens; identical to SEQ ID NO: 96426
  chr7:1328492-1328613
  Hypo

SEQ ID NO: 127009 - DNA, 67 bp, Homo sapiens; identical to SEQ ID NO: 96427
  chr7:1331210-1331277
  Hypo

SEQ ID NO: 127010 - DNA, 100 bp, Homo sapiens; identical to SEQ ID NO: 96428
  chr7:1333580-1333680
  Hypo

SEQ ID NO: 127011 - DNA, 30 bp, Homo sapiens; identical to SEQ ID NO: 96429
  chr7:1335995-1336025
  Hypo

SEQ ID NO: 127012 - DNA, 40 bp, Homo sapiens; identical to SEQ ID NO: 96431
  chr7:1339547-1339587
  Hypo

SEQ ID NO: 127013 - DNA, 45 bp, Homo sapiens; identical to SEQ ID NO: 96437
  chr7:1347390-1347435
  Hypo

SEQ ID NO: 127014 - DNA, 123 bp, Homo sapiens; identical to SEQ ID NO: 96444
  chr7:1351483-1351606
  Hypo

SEQ ID NO: 127015 - DNA, 30 bp, Homo sapiens; identical to SEQ ID NO: 96456
  chr7:1360286-1360316
  Hypo

SEQ ID NO: 127016 - DNA, 62 bp, Homo sapiens; identical to SEQ ID NO: 96458
  chr7:1363565-1363627
  Hypo

SEQ ID NO: 127017 - DNA, 144 bp, Homo sapiens; identical to SEQ ID NO: 41068
  chr7:1365367-1365511
  Hypo

SEQ ID NO: 127018 - DNA, 81 bp, Homo sapiens; identical to SEQ ID NO: 41069
  chr7:1368971-1369052
  Hypo

SEQ ID NO: 127019 - DNA, 30 bp, Homo sapiens; identical to SEQ ID NO: 96468
  chr7:1369753-1369783
  Hypo

SEQ ID NO: 127020 - DNA, 143 bp, Homo sapiens; identical to SEQ ID NO: 96480
  chr7:1384815-1384958
  Hypo

SEQ ID NO: 127021 - DNA, 205 bp, Homo sapiens; identical to SEQ ID NO: 96500
  chr7:1395730-1395935
  Hypo

SEQ ID NO: 127022 - DNA, 30 bp, Homo sapiens; identical to SEQ ID NO: 96503
  chr7:1397930-1397960
  Hypo

SEQ ID NO: 127023 - DNA, 596 bp, Homo sapiens
  chr7:1408479-1409075
  Hyper
ctgaaccccgggctgcgctctccccgcccctgcctggcgagtgcagattcccgcctattttccgacacccgcctgcagaggagtcgggcgccagatgggatcgaacccagcaaggtgagaaatccgggcggggtggcagatggggaggccttccccggggaactccaggagaggggaggacagcgagggccccgggcgcggcctctcgtgtgcccccagccgcggggcgcaggcccgcagccccccaggggcgccgcagctgtcactccgcggtgagtggcgccatccggatcggagatgggcgcggctgcatcgccccagggtaggaagctcatcttcggagaccgcgcggctccgagcgaccaggaacgccccctgcgggctgcgggcgggagcgcggaccccggcccatcccggaccccgcccaccgcggacctcacccatcctaggccccgcccatcccagacaccggcccatccctgaccccgcccgtccctagccccgcccaccaccgaccccacccctccagaccacgcctatcccaggccctgcccaccgcggaccccgcccatcctgcaccccgcccaccacggacc

SEQ ID NO: 127024 - DNA, 210 bp, Homo sapiens; identical to SEQ ID NO: 96538
  chr7:1416015-1416225
  Hypo

SEQ ID NO: 127025 - DNA, 264 bp, Homo sapiens; identical to SEQ ID NO: 96539
  chr7:1423398-1423662
  Hypo

SEQ ID NO: 127026 - DNA, 233 bp, Homo sapiens
  chr7:1443541-1443774
  Hyper
gggtggcgcctggcccggcatccacactcctggtgagctctgtttgttttcataaccaattcaatatttaagacccggccagccgcggccgcaagctctccagctcccccttcctttgtctctgccgctccctgcaccccgcctcgcacttcctctgacaaaccgtgcgattctgatggaaaattcattagtcggctggtctctttccctcccctctccgtgttcccaggcag

SEQ ID NO: 127027 - DNA, 132 bp, Homo sapiens; identical to SEQ ID NO: 96551
  chr7:1451244-1451376
  Hypo

SEQ ID NO: 127028 - DNA, 104 bp, Homo sapiens; identical to SEQ ID NO: 96552
  chr7:1452435-1452539
  Hyper

SEQ ID NO: 127029 - DNA, 30 bp, Homo sapiens; identical to SEQ ID NO: 41075
  chr7:1453817-1453847
  Hypo

SEQ ID NO: 127030 - DNA, 154 bp, Homo sapiens; identical to SEQ ID NO: 96558
  chr7:1458926-1459080
  Hypo

SEQ ID NO: 127031 - DNA, 185 bp, Homo sapiens; identical to SEQ ID NO: 96559
  chr7:1460773-1460958
  Hypo

SEQ ID NO: 127032 - DNA, 477 bp, Homo sapiens; identical to SEQ ID NO: 96608
  chr7:1503320-1503797
  Hypo

SEQ ID NO: 127033 - DNA, 30 bp, Homo sapiens; identical to SEQ ID NO: 96610
  chr7:1505469-1505499
  Hypo

SEQ ID NO: 127034 - DNA, 63 bp, Homo sapiens; identical to SEQ ID NO: 41080
  chr7:1516637-1516700
  Hypo

SEQ ID NO: 127035 - DNA, 42 bp, Homo sapiens; identical to SEQ ID NO: 41081
  chr7:1532979-1533021
  Hypo

SEQ ID NO: 127036 - DNA, 222 bp, Homo sapiens; identical to SEQ ID NO: 96712
  chr7:1547246-1547468
  Hypo

SEQ ID NO: 127037 - DNA, 136 bp, Homo sapiens; identical to SEQ ID NO: 96797
  chr7:1557959-1558095
  Hypo

SEQ ID NO: 127038 - DNA, 17 bp, Homo sapiens
  chr7:1596347-1596364
  Hypo
atttgttttctgggccg

SEQ ID NO: 127039 - DNA, 854 bp, Homo sapiens; identical to SEQ ID NO: 97062
  chr7:1598548-1599402
  Hypo

SEQ ID NO: 127040 - DNA, 316 bp, Homo sapiens; identical to SEQ ID NO: 97063
  chr7:1600538-1600854
  Hypo

SEQ ID NO: 127041 - DNA, 789 bp, Homo sapiens; identical to SEQ ID NO: 97064
  chr7:1607231-1608020
  Hypo

SEQ ID NO: 127042 - DNA, 78 bp, Homo sapiens; identical to SEQ ID NO: 97065
  chr7:1615015-1615093
  Hypo

SEQ ID NO: 127043 - DNA, 36 bp, Homo sapiens; identical to SEQ ID NO: 97066
  chr7:1620503-1620539
  Hypo

SEQ ID NO: 127044 - DNA, 40 bp, Homo sapiens; identical to SEQ ID NO: 97067
  chr7:1621494-1621534
  Hypo

SEQ ID NO: 127045 - DNA, 123 bp, Homo sapiens; identical to SEQ ID NO: 97068
  chr7:1624765-1624888
  Hypo

SEQ ID NO: 127046 - DNA, 266 bp, Homo sapiens
  chr7:1625802-1626068
  Hypo
tcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccggggg

SEQ ID NO: 127047 - DNA, 30 bp, Homo sapiens; identical to SEQ ID NO: 97070
  chr7:1640689-1640719
  Hypo

SEQ ID NO: 127048 - DNA, 308 bp, Homo sapiens; identical to SEQ ID NO: 97071
  chr7:1641670-1641978
  Hypo

SEQ ID NO: 127049 - DNA, 30 bp, Homo sapiens; identical to SEQ ID NO: 97076
  chr7:1654887-1654917
  Hypo

SEQ ID NO: 127050 - DNA, 30 bp, Homo sapiens; identical to SEQ ID NO: 97078
  chr7:1659704-1659734
  Hypo

SEQ ID NO: 127051 - DNA, 136 bp, Homo sapiens; identical to SEQ ID NO: 97080
  chr7:1680137-1680273
  Hypo

SEQ ID NO: 127052 - DNA, 50 bp, Homo sapiens; identical to SEQ ID NO: 97081
  chr7:1681189-1681239
  Hypo

SEQ ID NO: 127053 - DNA, 100 bp, Homo sapiens; identical to SEQ ID NO: 41092
  chr7:1684968-1685068
  Hypo

SEQ ID NO: 127054 - DNA, 151 bp, Homo sapiens; identical to SEQ ID NO: 97084
  chr7:1688950-1689101
  Hypo

SEQ ID NO: 127055 - DNA, 279 bp, Homo sapiens; identical to SEQ ID NO: 97085
  chr7:1690421-1690700
  Hypo

SEQ ID NO: 127056 - DNA, 30 bp, Homo sapiens; identical to SEQ ID NO: 97086
  chr7:1690977-1691007
  Hypo

SEQ ID NO: 127057 - DNA, 242 bp, Homo sapiens; identical to SEQ ID NO: 97087
  chr7:1693830-1694072
  Hypo

SEQ ID NO: 127058 - DNA, 106 bp, Homo sapiens; identical to SEQ ID NO: 97088
  chr7:1694880-1694986
  Hypo

SEQ ID NO: 127059 - DNA, 1232 bp, Homo sapiens
  chr7:1703921-1705153
  Hyper
taagggctggacagccgcaggcaggggctccgtccttggcctccacccttcgtgtccagcaatcccgggagcaggcggcggcacttcctccatgccccggcctcaatcacggtctcagtccccccaaccccgtcctgcaggaacaagtgtggtagaggctcggggtcggagggcgggcggccgtcccgcgggctggacggagtttctgggctgcggagaggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctcccggccgaaaggcggggggcgacgcgcaacggggagggaagggagggaggggtcggcgaccttaggggagggcgagtctctggggacgcggggccgccaggggcccgacgaccctctcgctccacctccccgcccccaagtgccccgctctccccccgccccgcaaacgcgcgtcctgcgggctgtgctttggccctcgcggacgcgcgcgctcacagagggtctgacttggggtcaacttccacgaggttgccgggcgcctgtgagcacagccgtgtccccacccaggggcccacctcccagcgccaccagggtcccgacccccagaccttcggacgcttctcttccaaaccgaagcctgggagcctctgggtggcctggggcgggggcagggggcg

SEQ ID NO: 127060 - DNA, 307 bp, Homo sapiens; identical to SEQ ID NO: 97090
  chr7:1705386-1705693
  Hyper

SEQ ID NO: 127061 - DNA, 538 bp, Homo sapiens; identical to SEQ ID NO: 97091
  chr7:1706195-1706733
  Hyper

SEQ ID NO: 127062 - DNA, 370 bp, Homo sapiens; identical to SEQ ID NO: 97092
  chr7:1706939-1707309
  Hyper

SEQ ID NO: 127063 - DNA, 1310 bp, Homo sapiens
  chr7:1709060-1710370
  Hyper
ggcttgtccaggcaccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggaccgcgaggacgccccctgcgctttctaggacctcccctccttccccagcccctgcgcgtcgccgggagagggaaggagcgggttgccgcggggagccgaggagagcagggggctcgggaggccagggagagaaggggagggccagaggctccgagccggactcgcggcggaggaagagggggtggaagggagcgcgcaggcgggcgagggagcgagggagggagagaaggagggagggagggagggaaggggggcgggagggggcagggcgagcttgaattcccccccggccgcgcggcgaggggcggggccgcgcgcgcagatcgatgggcgaagctggggaggaatttcaatcccgggagcgaagttagagcttgaaggacggcggcggctgcgggcgcagccccggaaccgaggccgggcgggcaggtaagcggcgagcgcggccgggcgctgaacctgggggacttgggacccggaccacccccggggagcggcgcggccaagccccccgccacctcgaaccccgggcgtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggtcgctgccgcagcccgcacgctgccccgtgcctccgagaggtcccttccccagcgcctctctcccttccgtcccccttcgccgtccgcaccctgcccggcgccccccagacgcggccccctgccctt

SEQ ID NO: 127064 - DNA, 76 bp, Homo sapiens; identical to SEQ ID NO: 97097
  chr7:1712668-1712744
  Hypo

SEQ ID NO: 127065 - DNA, 50 bp, Homo sapiens; identical to SEQ ID NO: 41096
  chr7:1714947-1714997
  Hypo

SEQ ID NO: 127066 - DNA, 178 bp, Homo sapiens; identical to SEQ ID NO: 97100
  chr7:1717985-1718163
  Hypo

SEQ ID NO: 127067 - DNA, 158 bp, Homo sapiens; identical to SEQ ID NO: 97101
  chr7:1719538-1719696
  Hypo

SEQ ID NO: 127068 - DNA, 206 bp, Homo sapiens; identical to SEQ ID NO: 41098
  chr7:1731744-1731950
  Hypo

SEQ ID NO: 127069 - DNA, 278 bp, Homo sapiens; identical to SEQ ID NO: 97103
  chr7:1733166-1733444
  Hypo

SEQ ID NO: 127070 - DNA, 366 bp, Homo sapiens; identical to SEQ ID NO: 97106
  chr7:1734686-1735052
  Hypo

SEQ ID NO: 127071 - DNA, 174 bp, Homo sapiens; identical to SEQ ID NO: 97108
  chr7:1744404-1744578
  Hypo

SEQ ID NO: 127072 - DNA, 558 bp, Homo sapiens; identical to SEQ ID NO: 97109
  chr7:1775495-1776053
  Hypo

SEQ ID NO: 127073 - DNA, 30 bp, Homo sapiens; identical to SEQ ID NO: 97110
  chr7:1777547-1777577
  Hypo

SEQ ID NO: 127074 - DNA, 51 bp, Homo sapiens; identical to SEQ ID NO: 97111
  chr7:1779654-1779705
  Hypo

SEQ ID NO: 127075 - DNA, 192 bp, Homo sapiens; identical to SEQ ID NO: 97112
  chr7:1783194-1783386
  Hypo

SEQ ID NO: 127076 - DNA, 231 bp, Homo sapiens; identical to SEQ ID NO: 97113
  chr7:1784226-1784457
  Hypo

SEQ ID NO: 127077 - DNA, 237 bp, Homo sapiens; identical to SEQ ID NO: 97114
  chr7:1784690-1784927
  Hypo

SEQ ID NO: 127078 - DNA, 506 bp, Homo sapiens; identical to SEQ ID NO: 97115
  chr7:1786393-1786899
  Hypo

SEQ ID NO: 127079 - DNA, 282 bp, Homo sapiens; identical to SEQ ID NO: 97116
  chr7:1787137-1787419
  Hypo

SEQ ID NO: 127080 - DNA, 30 bp, Homo sapiens; identical to SEQ ID NO: 97117
  chr7:1790379-1790409
  Hypo

SEQ ID NO: 127081 - DNA, 73 bp, Homo sapiens; identical to SEQ ID NO: 97118
  chr7:1795137-1795210
  Hypo

SEQ ID NO: 127082 - DNA, 30 bp, Homo sapiens; identical to SEQ ID NO: 97119
  chr7:1797456-1797486
  Hypo

SEQ ID NO: 127083 - DNA, 30 bp, Homo sapiens; identical to SEQ ID NO: 97120
  chr7:1798877-1798907
  Hypo

SEQ ID NO: 127084 - DNA, 91 bp, Homo sapiens; identical to SEQ ID NO: 97121
  chr7:1800821-1800912
  Hypo

SEQ ID NO: 127085 - DNA, 30 bp, Homo sapiens; identical to SEQ ID NO: 97126
  chr7:1819163-1819193
  Hypo

SEQ ID NO: 127086 - DNA, 79 bp, Homo sapiens; identical to SEQ ID NO: 97127
  chr7:1838908-1838987
  Hypo

SEQ ID NO: 127087 - DNA, 49 bp, Homo sapiens; identical to SEQ ID NO: 97128
  chr7:1849747-1849796
  Hypo

SEQ ID NO: 127088 - DNA, 40 bp, Homo sapiens; identical to SEQ ID NO: 97130
  chr7:1879361-1879401
  Hypo

SEQ ID NO: 127089 - DNA, 30 bp, Homo sapiens; identical to SEQ ID NO: 97131
  chr7:1883040-1883070
  Hypo

SEQ ID NO: 127090 - DNA, 30 bp, Homo sapiens; identical to SEQ ID NO: 97132
  chr7:1888859-1888889
  Hypo

SEQ ID NO: 127091 - DNA, 30 bp, Homo sapiens; identical to SEQ ID NO: 97133
  chr7:1913796-1913826
  Hypo

SEQ ID NO: 127092 - DNA, 104 bp, Homo sapiens; identical to SEQ ID NO: 97154
  chr7:1931869-1931973
  Hypo

SEQ ID NO: 127093 - DNA, 150 bp, Homo sapiens; identical to SEQ ID NO: 97157
  chr7:1962361-1962511
  Hypo

SEQ ID NO: 127094 - DNA, 52 bp, Homo sapiens; identical to SEQ ID NO: 97158
  chr7:1970869-1970921
  Hypo

SEQ ID NO: 127095 - DNA, 30 bp, Homo sapiens; identical to SEQ ID NO: 41114
  chr7:2024812-2024842
  Hypo

SEQ ID NO: 127096 - DNA, 35 bp, Homo sapiens; identical to SEQ ID NO: 97161
  chr7:2037950-2037985
  Hypo

SEQ ID NO: 127097 - DNA, 132 bp, Homo sapiens; identical to SEQ ID NO: 97162
  chr7:2056554-2056686
  Hypo

SEQ ID NO: 127098 - DNA, 114 bp, Homo sapiens; identical to SEQ ID NO: 97191
  chr7:2110154-2110268
  Hypo

SEQ ID NO: 127099 - DNA, 30 bp, Homo sapiens; identical to SEQ ID NO: 97192
  chr7:2120265-2120295
  Hypo

SEQ ID NO: 127100 - DNA, 103 bp, Homo sapiens; identical to SEQ ID NO: 97198
  chr7:2163294-2163397
  Hypo

SEQ ID NO: 127101 - DNA, 30 bp, Homo sapiens; identical to SEQ ID NO: 97200
  chr7:2197210-2197240
  Hypo

SEQ ID NO: 127102 - DNA, 317 bp, Homo sapiens; identical to SEQ ID NO: 97201
  chr7:2206439-2206756
  Hypo

SEQ ID NO: 127103 - DNA, 120 bp, Homo sapiens; identical to SEQ ID NO: 97202
  chr7:2208724-2208844
  Hypo

SEQ ID NO: 127104 - DNA, 165 bp, Homo sapiens; identical to SEQ ID NO: 97203
  chr7:2232891-2233056
  Hypo

SEQ ID NO: 127105 - DNA, 178 bp, Homo sapiens; identical to SEQ ID NO: 97204
  chr7:2233292-2233470
  Hypo

SEQ ID NO: 127106 - DNA, 154 bp, Homo sapiens; identical to SEQ ID NO: 41122
  chr7:2238153-2238307
  Hypo

SEQ ID NO: 127107 - DNA, 230 bp, Homo sapiens; identical to SEQ ID NO: 97209
  chr7:2265011-2265241
  Hypo

SEQ ID NO: 127108 - DNA, 85 bp, Homo sapiens; identical to SEQ ID NO: 41123
  chr7:2265530-2265615
  Hypo

SEQ ID NO: 127109 - DNA, 16 bp, Homo sapiens
  chr7:2300787-2300803
  Hypo
ctgggcacagaggctc

SEQ ID NO: 127110 - DNA, 79 bp, Homo sapiens; identical to SEQ ID NO: 97222
  chr7:2349353-2349432
  Hypo

SEQ ID NO: 127111 - DNA, 83 bp, Homo sapiens; identical to SEQ ID NO: 41126
  chr7:2420313-2420396
  Hypo

SEQ ID NO: 127112 - DNA, 161 bp, Homo sapiens; identical to SEQ ID NO: 97238
  chr7:2436226-2436387
  Hypo

SEQ ID NO: 127113 - DNA, 216 bp, Homo sapiens
  chr7:2473296-2473512
  Hypo
gctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccg

SEQ ID NO: 127114 - DNA, 42 bp, Homo sapiens
  chr7:2473722-2473764
  Hypo
atcccctctcccctccgcccgcccacccgcccgcccgctcgc

SEQ ID NO: 127115 - DNA, 30 bp, Homo sapiens; identical to SEQ ID NO: 97243
  chr7:2477693-2477723
  Hypo

SEQ ID NO: 127116 - DNA, 157 bp, Homo sapiens; identical to SEQ ID NO: 97247
  chr7:2480354-2480511
  Hypo

SEQ ID NO: 127117 - DNA, 30 bp, Homo sapiens; identical to SEQ ID NO: 97248
  chr7:2480719-2480749
  Hypo

SEQ ID NO: 127118 - DNA, 37 bp, Homo sapiens; identical to SEQ ID NO: 97250
  chr7:2499681-2499718
  Hypo

SEQ ID NO: 127119 - DNA, 47 bp, Homo sapiens; identical to SEQ ID NO: 97254
  chr7:2515514-2515561
  Hypo

SEQ ID NO: 127120 - DNA, 164 bp, Homo sapiens; identical to SEQ ID NO: 97257
  chr7:2544463-2544627
  Hypo

SEQ ID NO: 127121 - DNA, 33 bp, Homo sapiens; identical to SEQ ID NO: 97259
  chr7:2551467-2551500
  Hyper

SEQ ID NO: 127122 - DNA, 109 bp, Homo sapiens
  chr7:2558415-2558524
  Hyper
ttccggaggacgtggcgggcagggggctcacaccctgctcaggcgacccttggccacttccgggcccctcgcccctcaccctcggctgccggcgcgcattcctgccgcc

SEQ ID NO: 127123 - DNA, 89 bp, Homo sapiens; identical to SEQ ID NO: 97264
  chr7:2560970-2561059
  Hyper

SEQ ID NO: 127124 - DNA, 438 bp, Homo sapiens; identical to SEQ ID NO: 97265
  chr7:2564642-2565080
  Hypo

SEQ ID NO: 127125 - DNA, 617 bp, Homo sapiens; identical to SEQ ID NO: 97266
  chr7:2566041-2566658
  Hypo

SEQ ID NO: 127126 - DNA, 44 bp, Homo sapiens; identical to SEQ ID NO: 97267
  chr7:2566895-2566939
  Hypo

SEQ ID NO: 127127 - DNA, 30 bp, Homo sapiens; identical to SEQ ID NO: 97275
  chr7:2612457-2612487
  Hypo

SEQ ID NO: 127128 - DNA, 55 bp, Homo sapiens; identical to SEQ ID NO: 97284
  chr7:2652597-2652652
  Hypo

SEQ ID NO: 127129 - DNA, 35 bp, Homo sapiens; identical to SEQ ID NO: 97286
  chr7:2658370-2658405
  Hypo

SEQ ID NO: 127130 - DNA, 463 bp, Homo sapiens; identical to SEQ ID NO: 97289
  chr7:2686448-2686911
  Hypo

SEQ ID NO: 127131 - DNA, 62 bp, Homo sapiens; identical to SEQ ID NO: 97291
  chr7:2700087-2700149
  Hypo

SEQ ID NO: 127132 - DNA, 203 bp, Homo sapiens; identical to SEQ ID NO: 97296
  chr7:2718466-2718669
  Hypo

SEQ ID NO: 127133 - DNA, 127 bp, Homo sapiens; identical to SEQ ID NO: 97304
  chr7:2720013-2720140
  Hypo

SEQ ID NO: 127134 - DNA, 440 bp, Homo sapiens
  chr7:2727819-2728259
  Hyper
gtcaccgggacctcccgatcctcccggcccaggccgagctgcccacgctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggctacgggcgcgcggggaccgcggagacgcgaagggcgcacttggcgagggtttggtgcagcgccgcgccggggtccgcacagccccggcaggtcctgcagagggaaggccgggccagggaagggccacgcgccccctccccgccatcctctcccaggccagggcgacctgcgcgcttcccgatgggagcaaact

SEQ ID NO: 127135 - DNA, 17 bp, Homo sapiens
  chr7:2731870-2731887
  Hypo
gggttgaaagaggaccg

SEQ ID NO: 127136 - DNA, 98 bp, Homo sapiens; identical to SEQ ID NO: 97350
  chr7:2747103-2747201
  Hypo

SEQ ID NO: 127137 - DNA, 30 bp, Homo sapiens; identical to SEQ ID NO: 97355
  chr7:2770610-2770640
  Hypo

SEQ ID NO: 127138 - DNA, 80 bp, Homo sapiens; identical to SEQ ID NO: 97361
  chr7:2798456-2798536
  Hypo

SEQ ID NO: 127139 - DNA, 75 bp, Homo sapiens; identical to SEQ ID NO: 97377
  chr7:2864022-2864097
  Hypo

SEQ ID NO: 127140 - DNA, 164 bp, Homo sapiens; identical to SEQ ID NO: 97388
  chr7:2900214-2900378
  Hypo

SEQ ID NO: 127141 - DNA, 44 bp, Homo sapiens; identical to SEQ ID NO: 97389
  chr7:2916072-2916116
  Hypo

SEQ ID NO: 127142 - DNA, 30 bp, Homo sapiens; identical to SEQ ID NO: 97391
  chr7:2920175-2920205
  Hypo

SEQ ID NO: 127143 - DNA, 206 bp, Homo sapiens; identical to SEQ ID NO: 97393
  chr7:2923723-2923929
  Hypo

SEQ ID NO: 127144 - DNA, 30 bp, Homo sapiens; identical to SEQ ID NO: 97395
  chr7:2946546-2946576
  Hypo

SEQ ID NO: 127145 - DNA, 34 bp, Homo sapiens; identical to SEQ ID NO: 97397
  chr7:2950000-2950034
  Hypo

SEQ ID NO: 127146 - DNA, 30 bp, Homo sapiens; identical to SEQ ID NO: 97398
  chr7:2954959-2954989
  Hypo

SEQ ID NO: 127147 - DNA, 30 bp, Homo sapiens; identical to SEQ ID NO: 97399
  chr7:2958214-2958244
  Hypo

SEQ ID NO: 127148 - DNA, 30 bp, Homo sapiens; identical to SEQ ID NO: 41142
  chr7:2958507-2958537
  Hypo

SEQ ID NO: 127149 - DNA, 203 bp, Homo sapiens; identical to SEQ ID NO: 97402
  chr7:2960538-2960741
  Hypo

SEQ ID NO: 127150 - DNA, 30 bp, Homo sapiens; identical to SEQ ID NO: 97403
  chr7:2961827-2961857
  Hypo

SEQ ID NO: 127151 - DNA, 34 bp, Homo sapiens; identical to SEQ ID NO: 97404
  chr7:2963968-2964002
  Hypo

SEQ ID NO: 127152 - DNA, 73 bp, Homo sapiens; identical to SEQ ID NO: 41143
  chr7:2966469-2966542
  Hypo

SEQ ID NO: 127153 - DNA, 160 bp, Homo sapiens; identical to SEQ ID NO: 97407
  chr7:2972398-2972558
  Hypo

SEQ ID NO: 127154 - DNA, 63 bp, Homo sapiens; identical to SEQ ID NO: 97409
  chr7:2976839-2976902
  Hypo

SEQ ID NO: 127155 - DNA, 173 bp, Homo sapiens; identical to SEQ ID NO: 97421
  chr7:3026166-3026339
  Hypo

SEQ ID NO: 127156 - DNA, 321 bp, Homo sapiens; identical to SEQ ID NO: 41146
  chr7:3033477-3033798
  Hypo

SEQ ID NO: 127157 - DNA, 30 bp, Homo sapiens; identical to SEQ ID NO: 97424
  chr7:3044096-3044126
  Hypo

SEQ ID NO: 127158 - DNA, 59 bp, Homo sapiens; identical to SEQ ID NO: 97425
  chr7:3052608-3052667
  Hypo

SEQ ID NO: 127159 - DNA, 30 bp, Homo sapiens; identical to SEQ ID NO: 97434
  chr7:3074446-3074476
  Hypo

SEQ ID NO: 127160 - DNA, 476 bp, Homo sapiens
  chr7:3083126-3083602
  Hyper
ggatacccccagcatcgcgggaccagcgggagccactcccatcccccgacgccccccccgccaccgtgtcatctcactgatgccccccatctcctccccgtgccctcttctcttcccccaactccccgcctcgtgctccccctccgccagctcccccatccccgctgcgcctacctggggcgctcatgctccgccagccagctgcgcggggcgcctcctccacgcaggcctccggcttcctccaggcgaccaggccctccgtccccccgggcccggagccgtcctccgaggggcgccgcccgcccaggggctgcagggccgggagggggctgcgggcggcgcgggcaggagtccgaaggccagaggaggcaggagagaaaaaaggagagaaagtatgtcataggctgggaggggcgggggagggaaatgcaaaacccgacaggaaatgagactaaaaaatgcgaaaggttagaaaa

SEQ ID NO: 127161 - DNA, 396 bp, Homo sapiens; identical to SEQ ID NO: 41147
  chr7:3283498-3283894
  Hypo

SEQ ID NO: 127162 - DNA, 25 bp, Homo sapiens
  chr7:3287058-3287083
  Hypo
aatagggccaggcaccgtggctcac

SEQ ID NO: 127163 - DNA, 2353 bp, Homo sapiens
  chr7:3339931-3342284
  Hyper
ttacatgatctcatgcgaccatcatcacacgtccccaggctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggccgggctgtgaatggggagcggcggccgcggcagctgagggcgagcgcgaccgcgacgtgcgggcgggcgcactttcttctcagcgccgggcgggggcggcggcggcggcggctcctccgcgcccggcggacccctcggagctagcgcggcgggctcgggactgcgtgagcgccggacgcgaatttcccccgttgacaacttcttctcgcccggctcgtccccggcccgcgccgcgcccctcacgcggggacccaggacgccgcccctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctg

SEQ ID NO: 127164 - DNA, 38 bp, Homo sapiens; identical to SEQ ID NO: 41148
  chr7:3727142-3727180
  Hypo

SEQ ID NO: 127165 - DNA, 33 bp, Homo sapiens; identical to SEQ ID NO: 97535
  chr7:3771086-3771119
  Hypo

SEQ ID NO: 127166 - DNA, 34 bp, Homo sapiens; identical to SEQ ID NO: 97569
  chr7:3942787-3942821
  Hypo

SEQ ID NO: 127167 - DNA, 30 bp, Homo sapiens; identical to SEQ ID NO: 97572
  chr7:3991878-3991908
  Hypo

SEQ ID NO: 127168 - DNA, 41 bp, Homo sapiens; identical to SEQ ID NO: 97574
  chr7:4000133-4000174
  Hypo

SEQ ID NO: 127169 - DNA, 30 bp, Homo sapiens; identical to SEQ ID NO: 97575
  chr7:4000394-4000424
  Hypo

SEQ ID NO: 127170 - DNA, 30 bp, Homo sapiens; identical to SEQ ID NO: 97576
  chr7:4006028-4006058
  Hypo

SEQ ID NO: 127171 - DNA, 188 bp, Homo sapiens; identical to SEQ ID NO: 97580
  chr7:4056761-4056949
  Hypo

SEQ ID NO: 127172 - DNA, 30 bp, Homo sapiens; identical to SEQ ID NO: 97582
  chr7:4066497-4066527
  Hypo

SEQ ID NO: 127173 - DNA, 30 bp, Homo sapiens; identical to SEQ ID NO: 97583
  chr7:4070228-4070258
  Hypo

SEQ ID NO: 127174 - DNA, 97 bp, Homo sapiens; identical to SEQ ID NO: 97587
  chr7:4096353-4096450
  Hypo

SEQ ID NO: 127175 - DNA, 30 bp, Homo sapiens; identical to SEQ ID NO: 97590
  chr7:4119957-4119987
  Hypo

SEQ ID NO: 127176 - DNA, 30 bp, Homo sapiens; identical to SEQ ID NO: 97591
  chr7:4139378-4139408
  Hypo

SEQ ID NO: 127177 - DNA, 30 bp, Homo sapiens; identical to SEQ ID NO: 97592
  chr7:4147449-4147479
  Hypo

SEQ ID NO: 127178 - DNA, 160 bp, Homo sapiens; identical to SEQ ID NO: 97597
  chr7:4183288-4183448
  Hypo

SEQ ID NO: 127179 - DNA, 56 bp, Homo sapiens; identical to SEQ ID NO: 97600
  chr7:4187810-4187866
  Hypo

SEQ ID NO: 127180 - DNA, 42 bp, Homo sapiens; identical to SEQ ID NO: 97601
  chr7:4189003-4189045
  Hypo

SEQ ID NO: 127181 - DNA, 30 bp, Homo sapiens; identical to SEQ ID NO: 97606
  chr7:4206325-4206355
  Hypo

SEQ ID NO: 127182 - DNA, 30 bp, Homo sapiens; identical to SEQ ID NO: 97607
  chr7:4211243-4211273
  Hypo

SEQ ID NO: 127183 - DNA, 172 bp, Homo sapiens; identical to SEQ ID NO: 97608
  chr7:4214921-4215093
  Hypo

SEQ ID NO: 127184 - DNA, 50 bp, Homo sapiens; identical to SEQ ID NO: 97609
  chr7:4215324-4215374
  Hypo

SEQ ID NO: 127185 - DNA, 30 bp, Homo sapiens; identical to SEQ ID NO: 97615
  chr7:4251136-4251166
  Hypo

SEQ ID NO: 127186 - DNA, 30 bp, Homo sapiens; identical to SEQ ID NO: 41152
  chr7:4260867-4260897
  Hypo

SEQ ID NO: 127187 - DNA, 30 bp, Homo sapiens; identical to SEQ ID NO: 97619
  chr7:4265593-4265623
  Hypo

SEQ ID NO: 127188 - DNA, 55 bp, Homo sapiens; identical to SEQ ID NO: 97620
  chr7:4275488-4275543
  Hypo

SEQ ID NO: 127189 - DNA, 30 bp, Homo sapiens; identical to SEQ ID NO: 97621
  chr7:4287245-4287275
  Hypo

SEQ ID NO: 127190 - DNA, 92 bp, Homo sapiens; identical to SEQ ID NO: 97624
  chr7:4299734-4299826
  Hypo

SEQ ID NO: 127191 - DNA, 30 bp, Homo sapiens; identical to SEQ ID NO: 97626
  chr7:4308164-4308194
  Hypo

SEQ ID NO: 127192 - DNA, 88 bp, Homo sapiens; identical to SEQ ID NO: 97636
  chr7:4342694-4342782
  Hypo

SEQ ID NO: 127193 - DNA, 30 bp, Homo sapiens; identical to SEQ ID NO: 97637
  chr7:4345969-4345999
  Hypo

SEQ ID NO: 127194 - DNA, 83 bp, Homo sapiens; identical to SEQ ID NO: 97668
  chr7:4463665-4463748
  Hypo

SEQ ID NO: 127195 - DNA, 30 bp, Homo sapiens; identical to SEQ ID NO: 97672
  chr7:4479737-4479767
  Hypo

SEQ ID NO: 127196 - DNA, 181 bp, Homo sapiens; identical to SEQ ID NO: 97709
  chr7:4751426-4751607
  Hypo

SEQ ID NO: 127197 - DNA, 150 bp, Homo sapiens; identical to SEQ ID NO: 97714
  chr7:4771565-4771715
  Hypo

SEQ ID NO: 127198 - DNA, 147 bp, Homo sapiens; identical to SEQ ID NO: 97715
  chr7:4781931-4782078
  Hypo

SEQ ID NO: 127199 - DNA, 30 bp, Homo sapiens; identical to SEQ ID NO: 97716
  chr7:4782599-4782629
  Hypo

SEQ ID NO: 127200 - DNA, 40 bp, Homo sapiens; identical to SEQ ID NO: 97717
  chr7:4784887-4784927
  Hyper

SEQ ID NO: 127201 - DNA, 68 bp, Homo sapiens; identical to SEQ ID NO: 31019
  chr7:4785735-4785803
  Hyper

SEQ ID NO: 127202 - DNA, 37 bp, Homo sapiens; identical to SEQ ID NO: 97719
  chr7:4802552-4802589
  Hypo

SEQ ID NO: 127203 - DNA, 30 bp, Homo sapiens; identical to SEQ ID NO: 97720
  chr7:4805834-4805864
  Hypo

SEQ ID NO: 127204 - DNA, 157 bp, Homo sapiens; identical to SEQ ID NO: 97722
  chr7:4813713-4813870
  Hypo

SEQ ID NO: 127205 - DNA, 137 bp, Homo sapiens; identical to SEQ ID NO: 97723
  chr7:4837861-4837998
  Hyper

SEQ ID NO: 127206 - DNA, 288 bp, Homo sapiens; identical to SEQ ID NO: 97724
  chr7:4839163-4839451
  Hypo

SEQ ID NO: 127207 - DNA, 175 bp, Homo sapiens; identical to SEQ ID NO: 41160
  chr7:4840176-4840351
  Hypo

SEQ ID NO: 127208 - DNA, 30 bp, Homo sapiens; identical to SEQ ID NO: 41161
  chr7:4840692-4840722
  Hypo

SEQ ID NO: 127209 - DNA, 177 bp, Homo sapiens; identical to SEQ ID NO: 97727
  chr7:4841057-4841234
  Hypo

SEQ ID NO: 127210 - DNA, 138 bp, Homo sapiens; identical to SEQ ID NO: 97728
  chr7:4843211-4843349
  Hypo

SEQ ID NO: 127211 - DNA, 152 bp, Homo sapiens; identical to SEQ ID NO: 97730
  chr7:4855938-4856090
  Hypo

SEQ ID NO: 127212 - DNA, 453 bp, Homo sapiens; identical to SEQ ID NO: 97731
  chr7:4856843-4857296
  Hypo

SEQ ID NO: 127213 - DNA, 355 bp, Homo sapiens; identical to SEQ ID NO: 97732
  chr7:4857971-4858326
  Hypo

SEQ ID NO: 127214 - DNA, 30 bp, Homo sapiens; identical to SEQ ID NO: 97733
  chr7:4864784-4864814
  Hypo

SEQ ID NO: 127215 - DNA, 112 bp, Homo sapiens; identical to SEQ ID NO: 97734
  chr7:4867556-4867668
  Hypo

SEQ ID NO: 127216 - DNA, 30 bp, Homo sapiens; identical to SEQ ID NO: 97735
  chr7:4873587-4873617
  Hypo

SEQ ID NO: 127217 - DNA, 30 bp, Homo sapiens; identical to SEQ ID NO: 97736
  chr7:4874233-4874263
  Hypo

SEQ ID NO: 127218 - DNA, 59 bp, Homo sapiens; identical to SEQ ID NO: 41165
  chr7:4875008-4875067
  Hypo

SEQ ID NO: 127219 - DNA, 30 bp, Homo sapiens; identical to SEQ ID NO: 97738
  chr7:4876009-4876039
  Hypo

SEQ ID NO: 127220 - DNA, 30 bp, Homo sapiens; identical to SEQ ID NO: 41166
  chr7:4876594-4876624
  Hypo

SEQ ID NO: 127221 - DNA, 205 bp, Homo sapiens; identical to SEQ ID NO: 97740
  chr7:4918324-4918529
  Hypo

SEQ ID NO: 127222 - DNA, 1080 bp, Homo sapiens
  chr7:4922549-4923629
  Hyper
gatggtccgcagccccgccagggccctgccaaccccaccaacaggctcctcctgcgaggccccaggagctcggctcagcatctgttatcttggatgcagtatttgtcgaggggctggaaatggtacataaatagccgggaaacaatgctttgagctggcgcacgagtggggatcgggctgcaaccgggacggggtatgtgcaggggacgtctcgccggcccaggtgggagagcgcgcggaaccctgcgccccgctcccccgctgcgccccgctcccccgctgcgcgccccggacgaagctccccctccagggcacagccgggaaaactgagggccgagagtcccctggagttgggggtccggggcccacgcggacagccaggctcaggagctctcgggggtcggcagcgcggacccccggatccccgcaggctgggccgcccttgcccgcgctagccggcctccgggtaccgccccccggtccaggccggggcccgacagccagtcggttcccatggcaactgggcaaacctgccctccgcgccccgaccagcggccgggagtgtccccgagcgcgccccgcggcctccgcgccccaggtccccggcagcggccgagcagcgccccttacgagccacccccggttccgcagtcactcctcgcgcaccccacactcacctccggcacaacccgccgcgccgccacgttcccgcgctgctcccacccgccgttggctggggccggcgcccagacccgcgcgtgccgcggcgcctcctgccggcggcgcaacgggcggggcggggcctcaaggggacggggccacaaagggtggggcgggggagaacaggtgggctggagctgggcctcggcgcccaataggcagaaagaaagcctcgaggaggcggggtctccaggagaggggcggggccaacctgctagaaaaggcgggctgtgctctggcgcctcctgccggccgcccaatggacggggatgcagcctcgagggggcggggcctcaccggagaggcggggttttgaagaaaggggtggggctggttgtggagaggcgggacttgcagccc

SEQ ID NO: 127223 - DNA, 39 bp, Homo sapiens; identical to SEQ ID NO: 41168
  chr7:4931853-4931892
  Hypo

SEQ ID NO: 127224 - DNA, 174 bp, Homo sapiens; identical to SEQ ID NO: 97747
  chr7:4956774-4956948
  Hypo

SEQ ID NO: 127225 - DNA, 30 bp, Homo sapiens; identical to SEQ ID NO: 97748
  chr7:4966300-4966330
  Hypo

SEQ ID NO: 127226 - DNA, 27 bp, Homo sapiens
  chr7:4985872-4985899
  Hypo
cacaccccaccccgtgcacacaatccc

SEQ ID NO: 127227 - DNA, 958 bp, Homo sapiens
  chr7:4998165-4999123
  Hyper
cagaggtggtaccaacgccttttaccatgaacaagagtgcccaagagagaccgagcgtaactgcccgagcgtagctggcctgggctccaggcgctgcgcaaagtgctctgcaaggaccagctcgcttaatcctcacggcgacccaggacacggggactcgcataacccccgttttgcaaacgtggaaatgaggttcagagaagtgaagcgacttgcccaatggcacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccgcggccgccgctcacctcgcgtatttcgtcttctggaaatccagcagccggggggcgaacatcgcggcgcttccatgggaatctggccccgggctcagagcgcgggtagctggcagagcctggggggcgcggcggcggcagcagcaggttggagggcgcgcggcgggggccaaggggacctggtcggcgcccggagccggagccggagcccgagccggagctggaggcgcccggagccgccgacgccaaatcccgagcagatggtggcgggggcggggcgggcgggggcacgggggggctcccgggctcgcgctgccaatcgcctaagcccggccccctccctcccgcgaccccgccgcctccgctgaggtggaggagggtcgtggggagatgggggggtgggagaggtgggggtgaggaagtgggcgtaaggagtgggggcgggacggggggggtcctggctgcgcgcgcgagccacccatcgcccaggcctggggcggccctggccccggccccttttcccggtgccctccctgg

SEQ ID NO: 127228 - DNA, 30 bp, Homo sapiens; identical to SEQ ID NO: 97786
  chr7:5081846-5081876
  Hypo

SEQ ID NO: 127229 - DNA, 30 bp, Homo sapiens; identical to SEQ ID NO: 97790
  chr7:5112197-5112227
  Hyper

SEQ ID NO: 127230 - DNA, 37 bp, Homo sapiens; identical to SEQ ID NO: 97794
  chr7:5165566-5165603
  Hypo

SEQ ID NO: 127231 - DNA, 65 bp, Homo sapiens; identical to SEQ ID NO: 97799
  chr7:5262558-5262623
  Hypo

SEQ ID NO: 127232 - DNA, 111 bp, Homo sapiens; identical to SEQ ID NO: 97801
  chr7:5305461-5305572
  Hypo

SEQ ID NO: 127233 - DNA, 128 bp, Homo sapiens; identical to SEQ ID NO: 97804
  chr7:5316311-5316439
  Hypo

SEQ ID NO: 127234 - DNA, 19 bp, Homo sapiens
  chr7:5320472-5320491
  Hypo
cagccgtcatgaactttaa

SEQ ID NO: 127235 - DNA, 39 bp, Homo sapiens; identical to SEQ ID NO: 97806
  chr7:5323361-5323400
  Hyper

SEQ ID NO: 127236 - DNA, 30 bp, Homo sapiens; identical to SEQ ID NO: 97808
  chr7:5328996-5329026
  Hypo

SEQ ID NO: 127237 - DNA, 98 bp, Homo sapiens; identical to SEQ ID NO: 97809
  chr7:5334502-5334600
  Hypo

SEQ ID NO: 127238 - DNA, 160 bp, Homo sapiens; identical to SEQ ID NO: 97811
  chr7:5342789-5342949
  Hypo

SEQ ID NO: 127239 - DNA, 185 bp, Homo sapiens; identical to SEQ ID NO: 97812
  chr7:5343701-5343886
  Hypo

SEQ ID NO: 127240 - DNA, 142 bp, Homo sapiens; identical to SEQ ID NO: 41173
  chr7:5441304-5441446
  Hypo

SEQ ID NO: 127241 - DNA, 661 bp, Homo sapiens; identical to SEQ ID NO: 97815
  chr7:5458939-5459600
  Hyper

SEQ ID NO: 127242 - DNA, 93 bp, Homo sapiens; identical to SEQ ID NO: 97816
  chr7:5460480-5460573
  Hyper

SEQ ID NO: 127243 - DNA, 50 bp, Homo sapiens; identical to SEQ ID NO: 97824
  chr7:5464999-5465049
  Hyper

SEQ ID NO: 127244 - DNA, 30 bp, Homo sapiens; identical to SEQ ID NO: 97825
  chr7:5466477-5466507
  Hyper

SEQ ID NO: 127245 - DNA, 716 bp, Homo sapiens; identical to SEQ ID NO: 97826
  chr7:5467189-5467905
  Hyper

SEQ ID NO: 127246 - DNA, 30 bp, Homo sapiens; identical to SEQ ID NO: 97829
  chr7:5483425-5483455
  Hypo

SEQ ID NO: 127247 - DNA, 33 bp, Homo sapiens; identical to SEQ ID NO: 97832
  chr7:5494673-5494706
  Hypo

SEQ ID NO: 127248 - DNA, 195 bp, Homo sapiens; identical to SEQ ID NO: 97838
  chr7:5521589-5521784
  Hypo

SEQ ID NO: 127249 - DNA, 105 bp, Homo sapiens; identical to SEQ ID NO: 31029
  chr7:5526299-5526404
  Hyper

SEQ ID NO: 127250 - DNA, 116 bp, Homo sapiens; identical to SEQ ID NO: 41174
  chr7:5529839-5529955
  Hypo

SEQ ID NO: 127251 - DNA, 136 bp, Homo sapiens; identical to SEQ ID NO: 97849
  chr7:5589419-5589555
  Hypo

SEQ ID NO: 127252 - DNA, 198 bp, Homo sapiens; identical to SEQ ID NO: 97858
  chr7:5614360-5614558
  Hyper

SEQ ID NO: 127253 - DNA, 171 bp, Homo sapiens; identical to SEQ ID NO: 97864
  chr7:5626087-5626258
  Hypo

SEQ ID NO: 127254 - DNA, 43 bp, Homo sapiens; identical to SEQ ID NO: 97866
  chr7:5629890-5629933
  Hypo

SEQ ID NO: 127255 - DNA, 569 bp, Homo sapiens; identical to SEQ ID NO: 97867
  chr7:5632903-5633472
  Hyper

SEQ ID NO: 127256 - DNA, 102 bp, Homo sapiens; identical to SEQ ID NO: 97869
  chr7:5635640-5635742
  Hyper

SEQ ID NO: 127257 - DNA, 32 bp, Homo sapiens; identical to SEQ ID NO: 97870
  chr7:5637847-5637879
  Hypo

SEQ ID NO: 127258 - DNA, 23 bp, Homo sapiens
  chr7:5644690-5644713
  Hypo
actgcggccgagcagaacacgtt

SEQ ID NO: 127259 - DNA, 30 bp, Homo sapiens; identical to SEQ ID NO: 97872
  chr7:5645977-5646007
  Hypo

SEQ ID NO: 127260 - DNA, 581 bp, Homo sapiens; identical to SEQ ID NO: 97873
  chr7:5647838-5648419
  Hypo

SEQ ID NO: 127261 - DNA, 16 bp, Homo sapiens
  chr7:5862009-5862025
  Hypo
gcgcccaaccccaaaa

SEQ ID NO: 127262 - DNA, 30 bp, Homo sapiens; identical to SEQ ID NO: 97883
  chr7:5864832-5864862
  Hypo

SEQ ID NO: 127263 - DNA, 251 bp, Homo sapiens; identical to SEQ ID NO: 97884
  chr7:5896830-5897081
  Hypo

SEQ ID NO: 127264 - DNA, 30 bp, Homo sapiens; identical to SEQ ID NO: 97885
  chr7:6060451-6060481
  Hypo

SEQ ID NO: 127265 - DNA, 56 bp, Homo sapiens; identical to SEQ ID NO: 41180
  chr7:6060716-6060772
  Hypo

SEQ ID NO: 127266 - DNA, 147 bp, Homo sapiens; identical to SEQ ID NO: 97887
  chr7:6068145-6068292
  Hypo

SEQ ID NO: 127267 - DNA, 30 bp, Homo sapiens; identical to SEQ ID NO: 97888
  chr7:6068539-6068569
  Hypo

SEQ ID NO: 127268 - DNA, 17 bp, Homo sapiens
  chr7:6099217-6099234
  Hypo
tatgccacaaaaaaacg

SEQ ID NO: 127269 - DNA, 94 bp, Homo sapiens; identical to SEQ ID NO: 41182
  chr7:6124620-6124714
  Hypo

SEQ ID NO: 127270 - DNA, 33 bp, Homo sapiens; identical to SEQ ID NO: 97892
  chr7:6143243-6143276
  Hypo

SEQ ID NO: 127271 - DNA, 30 bp, Homo sapiens; identical to SEQ ID NO: 97893
  chr7:6188726-6188756
  Hypo

SEQ ID NO: 127272 - DNA, 32 bp, Homo sapiens; identical to SEQ ID NO: 97894
  chr7:6189029-6189061
  Hypo

SEQ ID NO: 127273 - DNA, 30 bp, Homo sapiens; identical to SEQ ID NO: 97895
  chr7:6203535-6203565
  Hypo

SEQ ID NO: 127274 - DNA, 64 bp, Homo sapiens; identical to SEQ ID NO: 41184
  chr7:6241990-6242054
  Hypo

SEQ ID NO: 127275 - DNA, 46 bp, Homo sapiens; identical to SEQ ID NO: 97908
  chr7:6386422-6386468
  Hypo

SEQ ID NO: 127276 - DNA, 30 bp, Homo sapiens; identical to SEQ ID NO: 97913
  chr7:6431846-6431876
  Hypo

SEQ ID NO: 127277 - DNA, 42 bp, Homo sapiens; identical to SEQ ID NO: 97922
  chr7:6438069-6438111
  Hypo

SEQ ID NO: 127278 - DNA, 196 bp, Homo sapiens; identical to SEQ ID NO: 97925
  chr7:6443279-6443475
  Hypo

SEQ ID NO: 127279 - DNA, 30 bp, Homo sapiens; identical to SEQ ID NO: 97926
  chr7:6443689-6443719
  Hypo

SEQ ID NO: 127280 - DNA, 34 bp, Homo sapiens; identical to SEQ ID NO: 41186
  chr7:6443956-6443990
  Hypo

SEQ ID NO: 127281 - DNA, 93 bp, Homo sapiens; identical to SEQ ID NO: 41187
  chr7:6444050-6444143
  Hypo

SEQ ID NO: 127282 - DNA, 62 bp, Homo sapiens; identical to SEQ ID NO: 97933
  chr7:6456254-6456316
  Hypo

SEQ ID NO: 127283 - DNA, 264 bp, Homo sapiens; identical to SEQ ID NO: 97940
  chr7:6499118-6499382
  Hypo

SEQ ID NO: 127284 - DNA, 30 bp, Homo sapiens; identical to SEQ ID NO: 97941
  chr7:6501094-6501124
  Hypo

SEQ ID NO: 127285 - DNA, 38 bp, Homo sapiens; identical to SEQ ID NO: 41189
  chr7:6524573-6524611
  Hypo

SEQ ID NO: 127286 - DNA, 180 bp, Homo sapiens; identical to SEQ ID NO: 41190
  chr7:6524911-6525091
  Hypo

SEQ ID NO: 127287 - DNA, 189 bp, Homo sapiens; identical to SEQ ID NO: 97947
  chr7:6543051-6543240
  Hyper

SEQ ID NO: 127288 - DNA, 311 bp, Homo sapiens; identical to SEQ ID NO: 97950
  chr7:6545692-6546003
  Hypo

SEQ ID NO: 127289 - DNA, 228 bp, Homo sapiens; identical to SEQ ID NO: 41192
  chr7:6560173-6560401
  Hypo

SEQ ID NO: 127290 - DNA, 643 bp, Homo sapiens
  chr7:6566051-6566694
  Hyper
ccagatgcccagccccgcccctacgccctctccccgggtctcggtcccgagcccacccgcagggaggcgcccgctgccagtgcctgtgagccccgcgtacctgcgcgcgcccccggggccggcgaggccgcccaccagcaaggaggccctgcgcgggggcggctcatcggggcggcgcggcggggcgctggcgcgcgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctggggggatcgggatgagcagccggtagcaccccagtctccccctcgctgctcggatttgcgcccccagctaggacttggcgtcctgctcgcttcacctcgggaatggcccgttcggaccgtcctccatgactctggccactgcagggcccgagcccctcaaagc

SEQ ID NO: 127291 - DNA, 755 bp, Homo sapiens
  chr7:6570454-6571209
  Hyper
gactctttagggccacgcacgggttctgagcgcccaacgcttagacctcgccgccccggtacccaccgagtttatttccaacctccctgggcctcgggctccgcccaggctcggagggtgcccacccagggcagggaagcccctccacgctccagccccacccgctttcagaccagcccgaggcggatccgtggcgcagagggcgcacggttcccggaggcgcgggacgcgatggggaagctaccgaaagtgccgagagaagccctggtccttccccatctggagccggggaccgcggcgcggcaggtgccgaagggcagggggtagccgagcccaggaatggagcgagcgcgccgcgactccacgcacctctgccctgcgagcgcgcgcggcccctcccgagccgtcccggcccgcagccccgccctggccccttttggtggccccgccccctccaggtagccccgcctctgccctgctgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagggctcagcaggagtcggccggctagaagaagcc

SEQ ID NO: 127292 - DNA, 64 bp, Homo sapiens; identical to SEQ ID NO: 97961
  chr7:6576033-6576097
  Hyper

SEQ ID NO: 127293 - DNA, 400 bp, Homo sapiens; identical to SEQ ID NO: 97972
  chr7:6654761-6655161
  Hyper

SEQ ID NO: 127294 - DNA, 30 bp, Homo sapiens; identical to SEQ ID NO: 31039
  chr7:6655418-6655448
  Hyper

SEQ ID NO: 127295 - DNA, 186 bp, Homo sapiens; identical to SEQ ID NO: 97974
  chr7:6655668-6655854
  Hyper

SEQ ID NO: 127296 - DNA, 600 bp, Homo sapiens
  chr7:6703488-6704088
  Hyper
agaaggtgtgccaggcgatggagggggtcggcgggggcggggcccgcactgtccccgccccatgtgggtggagcctcctgcccgggcctgtgtcgcggcagagcctggcgggctttgtgcgcaggcgcttgcggcttcgcggggctgaccgtgcgcttcgcctgcggggtcgtgctggggcggcgggtgagcctggggggctgcagagcgggcgcggggcgcgtccgaacagtcgcagccccgagcccctgggaccgccttccccgcggaggcttgggctcagcgcctggggcggaggtggggcgggggcggtccgcccgcagcagggggtgccggggccgcctccgggtttcctccgctggatgcggcggtggtgcgctgtcggcccggcgggtgcggcgggtgtggggtcacgggtgtcgcgcgccgccctgggccctcctccgaggtgcctcgcgtggggcccgtgccagggcccgctgagtcggggccgctcgtgggccgcctggctgccgcctggggcctccggccgctgcgtcccgcggcttctgggaaccgtgcgcgctcacaggcggacttgggcctcgaacaaggttcctg

SEQ ID NO: 127297 - DNA, 48 bp, Homo sapiens; identical to SEQ ID NO: 98010
  chr7:6966936-6966984
  Hypo

SEQ ID NO: 127298 - DNA, 141 bp, Homo sapiens; identical to SEQ ID NO: 98016
  chr7:7019112-7019253
  Hypo

SEQ ID NO: 127299 - DNA, 97 bp, Homo sapiens; identical to SEQ ID NO: 98027
  chr7:7097210-7097307
  Hypo

SEQ ID NO: 127300 - DNA, 217 bp, Homo sapiens; identical to SEQ ID NO: 98028
  chr7:7097367-7097584
  Hypo

SEQ ID NO: 127301 - DNA, 80 bp, Homo sapiens; identical to SEQ ID NO: 98029
  chr7:7098076-7098156
  Hypo

SEQ ID NO: 127302 - DNA, 93 bp, Homo sapiens; identical to SEQ ID NO: 98030
  chr7:7099482-7099575
  Hypo

SEQ ID NO: 127303 - DNA, 51 bp, Homo sapiens; identical to SEQ ID NO: 98031
  chr7:7101398-7101449
  Hypo

SEQ ID NO: 127304 - DNA, 45 bp, Homo sapiens; identical to SEQ ID NO: 98032
  chr7:7101778-7101823
  Hypo

SEQ ID NO: 127305 - DNA, 45 bp, Homo sapiens; identical to SEQ ID NO: 98033
  chr7:7101883-7101928
  Hypo

SEQ ID NO: 127306 - DNA, 30 bp, Homo sapiens; identical to SEQ ID NO: 98034
  chr7:7102527-7102557
  Hypo

SEQ ID NO: 127307 - DNA, 30 bp, Homo sapiens; identical to SEQ ID NO: 14975
  chr7:7102938-7102968
  Hypo

SEQ ID NO: 127308 - DNA, 37 bp, Homo sapiens; identical to SEQ ID NO: 98036
  chr7:7105793-7105830
  Hypo

SEQ ID NO: 127309 - DNA, 30 bp, Homo sapiens; identical to SEQ ID NO: 98037
  chr7:7106198-7106228
  Hypo

SEQ ID NO: 127310 - DNA, 61 bp, Homo sapiens; identical to SEQ ID NO: 41195
  chr7:7109343-7109404
  Hypo

SEQ ID NO: 127311 - DNA, 162 bp, Homo sapiens; identical to SEQ ID NO: 98039
  chr7:7110642-7110804
  Hypo

SEQ ID NO: 127312 - DNA, 360 bp, Homo sapiens; identical to SEQ ID NO: 98040
  chr7:7111756-7112116
  Hypo

SEQ ID NO: 127313 - DNA, 42 bp, Homo sapiens; identical to SEQ ID NO: 41197
  chr7:7113636-7113678
  Hypo

SEQ ID NO: 127314 - DNA, 30 bp, Homo sapiens; identical to SEQ ID NO: 98066
  chr7:7284851-7284881
  Hypo

SEQ ID NO: 127315 - DNA, 279 bp, Homo sapiens; identical to SEQ ID NO: 41198
  chr7:7605145-7605424
  Hypo

SEQ ID NO: 127316 - DNA, 158 bp, Homo sapiens; identical to SEQ ID NO: 41199
  chr7:7605664-7605822
  Hypo

SEQ ID NO: 127317 - DNA, 94 bp, Homo sapiens; identical to SEQ ID NO: 98076
  chr7:7606031-7606125
  Hypo

SEQ ID NO: 127318 - DNA, 40 bp, Homo sapiens; identical to SEQ ID NO: 98116
  chr7:8343744-8343784
  Hypo

SEQ ID NO: 127319 - DNA, 39 bp, Homo sapiens; identical to SEQ ID NO: 98118
  chr7:8391330-8391369
  Hypo

SEQ ID NO: 127320 - DNA, 2428 bp, Homo sapiens
  chr7:8473070-8475498
  Hyper
agagacagccagagtcggagcacagaggccgagtctgggagacgctggttgagtgggaggtgtcagtagcgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctccggcccggcagccacaggtcggaggcgcccggcgtcggcgctcgaggccggcaggggcgccctgcaccctcccgcgcccttccccgccctacgcgactcccggctgctcttcccgccactcccctgggctttgcgatcttccctacgccccccgggaagggggcgctgcggccaccgaagacaccgcgggagccacttgtccctgtgggcccagcccgcgagagcctgagagccggatctgtttacacagggtactaattagtctttgaggaatcattcacccacgtgccaaagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggtacgtaccctttgcctccgctgttcccggagggtacacctgggagcggggtggtgggcacgaggaagggacggcagggaggggcgctggttaggaaagagaacaagcctggcaggtgaccctcacagctcggaggaggcttcttctctagaagttagcgaccggctgtaccctttggctcgaaaaaagtagtgctagagatgtgactgtgagcattcgtgggtatctctgtgtgcgccaggggttcgaatgggtaaactgatccctgctttcctgtatgcaaattgcattctctttccccacccccacttcaccgaacgtgttgaggtacctagcacctaatcgcggtcagttctacctacctcttcctctcaccgcgcccccctcgctcaatctctctctctccctttatctttcccctctatctctctctgctggtgtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtaagtcttggaaggttcggggctttcgcatttttaccccggccgggaggcaaggaaactggggacacgcgggagaagggttacgccgccagttcagtgag

SEQ ID NO: 127321 - DNA, 445 bp, Homo sapiens; identical to SEQ ID NO: 98122
  chr7:8476305-8476750
  Hyper

SEQ ID NO: 127322 - DNA, 30 bp, Homo sapiens; identical to SEQ ID NO: 98124
  chr7:8477418-8477448
  Hyper

SEQ ID NO: 127323 - DNA, 329 bp, Homo sapiens; identical to SEQ ID NO: 98125
  chr7:8480721-8481050
  Hyper

SEQ ID NO: 127324 - DNA, 2713 bp, Homo sapiens
  chr7:8481310-8484023
  Hyper
caagctttccaagagcggctttttattgagataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccccggggtttcccagccgtagtggccgccgccacagctgcgcgctttattgtctgctttcagtcgcaggtgacctcgagcgatctcgacaggtttatggaaacacagatgcagccctctcgcgtccggagcccaagtccccatgcaaaagcgctgtttctgggtaattttcgtcgacgccaccaagcttcggtgcttttgggacagcgggctggatagcggcagttctcgggagaataggccgcgggctataagatttgatcgcgggcaggcgggcgtggggcacgccagggccgggagagcgactcttcagcaccacggccagcgccacaggctccgccccgcctggtgccagcagtagggcctgcctcccccgctgccgctccggctgggtccttaaagtcgagttagcactctcggtttccgcagatacctcctcaaggcccgctcgcgactgtgacgacccgcctaccccttccagctattcggggggcagctagctcccgtctctaggtccccagcatgacctgcggtcagaaactcttgcttgcacccctctccattaccacactcagtggttgcggcgtcacgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctgaggccctggcgagatttcggcctttagcttaa

SEQ ID NO: 127325 - DNA, 30 bp, Homo sapiens; identical to SEQ ID NO: 98253
  chr7:9766521-9766551
  Hypo

SEQ ID NO: 127326 - DNA, 22 bp, Homo sapiens
  chr7:9772342-9772364
  Hypo
ttacaggcgtgagccaccgtgc

SEQ ID NO: 127327 - DNA, 23 bp, Homo sapiens
  chr7:9955375-9955398
  Hypo
actgtgcccggccatgttgatga

SEQ ID NO: 127328 - DNA, 149 bp, Homo sapiens; identical to SEQ ID NO: 96187
  chr7:10730732-10730881
  Hypo

SEQ ID NO: 127329 - DNA, 37 bp, Homo sapiens; identical to SEQ ID NO: 41202
  chr7:10819400-10819437
  Hypo

SEQ ID NO: 127330 - DNA, 30 bp, Homo sapiens; identical to SEQ ID NO: 41203
  chr7:10929379-10929409
  Hypo

SEQ ID NO: 127331 - DNA, 465 bp, Homo sapiens; identical to SEQ ID NO: 31055
  chr7:11871392-11871857
  Hyper

SEQ ID NO: 127332 - DNA, 613 bp, Homo sapiens
  chr7:12151126-12151739
  Hyper
gacaagacttacaagcgacgatgctgacggtggactcttgcccagggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgcttctgatccctgcaagccgcccaccctgcgatcgccgggtcccgccctgacaatgccctgccgccagttccagccccagtgcagccgtcgccggtcctgtgcgcctctggtggcgcgtgcgccctgtccttccctgcccaagagggagaaccctcagtgccccagcctcagctctgcgcacagcggtcccctgcatgtccgcactcctgttctgtactgcacgctcgccagagcacagagccccatgtcccattgcgagggtcccacagagggcagtagccaccctcggaatccataccct

SEQ ID NO: 127333 - DNA, 30 bp, Homo sapiens; identical to SEQ ID NO: 96287
  chr7:12442920-12442950
  Hyper

SEQ ID NO: 127334 - DNA, 424 bp, Homo sapiens; identical to SEQ ID NO: 31058
  chr7:12443294-12443718
  Hyper

SEQ ID NO: 127335 - DNA, 30 bp, Homo sapiens; identical to SEQ ID NO: 31059
  chr7:12610212-12610242
  Hyper

SEQ ID NO: 127336 - DNA, 44 bp, Homo sapiens
  chr7:12610636-12610680
  Hyper
ccgacgcaccaaggccggcgaggggagggcgtaggggtctgaga

SEQ ID NO: 127337 - DNA, 44 bp, Homo sapiens; identical to SEQ ID NO: 96312
  chr7:12750788-12750832
  Hypo

SEQ ID NO: 127338 - DNA, 30 bp, Homo sapiens; identical to SEQ ID NO: 96313
  chr7:12751560-12751590
  Hypo

SEQ ID NO: 127339 - DNA, 23 bp, Homo sapiens
  chr7:12776931-12776954
  Hypo
agtcactgcgcctggccagtgtt

SEQ ID NO: 127340 - DNA, 30 bp, Homo sapiens; identical to SEQ ID NO: 96519
  chr7:14029041-14029071
  Hyper

SEQ ID NO: 127341 - DNA, 62 bp, Homo sapiens; identical to SEQ ID NO: 96520
  chr7:14029493-14029555
  Hyper

SEQ ID NO: 127342 - DNA, 384 bp, Homo sapiens; identical to SEQ ID NO: 96521
  chr7:14029885-14030269
  Hyper

SEQ ID NO: 127343 - DNA, 29 bp, Homo sapiens
  chr7:15431976-15432005
  Hypo
tgagtcaacatgcccggccctatttcctt

SEQ ID NO: 127344 - DNA, 155 bp, Homo sapiens; identical to SEQ ID NO: 96695
  chr7:15435723-15435878
  Hypo

SEQ ID NO: 127345 - DNA, 261 bp, Homo sapiens; identical to SEQ ID NO: 31061
  chr7:15725085-15725346
  Hyper

SEQ ID NO: 127346 - DNA, 570 bp, Homo sapiens; identical to SEQ ID NO: 96875
  chr7:15725636-15726206
  Hyper

SEQ ID NO: 127347 - DNA, 620 bp, Homo sapiens; identical to SEQ ID NO: 96878
  chr7:15726457-15727077
  Hyper

SEQ ID NO: 127348 - DNA, 54 bp, Homo sapiens; identical to SEQ ID NO: 31064
  chr7:15727290-15727344
  Hyper

SEQ ID NO: 127349 - DNA, 92 bp, Homo sapiens; identical to SEQ ID NO: 97072
  chr7:16437156-16437248
  Hypo

SEQ ID NO: 127350 - DNA, 191 bp, Homo sapiens; identical to SEQ ID NO: 97073
  chr7:16460326-16460517
  Hyper

SEQ ID NO: 127351 - DNA, 408 bp, Homo sapiens; identical to SEQ ID NO: 97074
  chr7:16460890-16461298
  Hyper

SEQ ID NO: 127352 - DNA, 189 bp, Homo sapiens; identical to SEQ ID NO: 97075
  chr7:16531866-16532055
  Hypo

SEQ ID NO: 127353 - DNA, 63 bp, Homo sapiens; identical to SEQ ID NO: 97077
  chr7:16566510-16566573
  Hypo

SEQ ID NO: 127354 - DNA, 47 bp, Homo sapiens; identical to SEQ ID NO: 97079
  chr7:16793964-16794011
  Hyper

SEQ ID NO: 127355 - DNA, 227 bp, Homo sapiens; identical to SEQ ID NO: 97082
  chr7:16844142-16844369
  Hypo

SEQ ID NO: 127356 - DNA, 30 bp, Homo sapiens; identical to SEQ ID NO: 97104
  chr7:17339561-17339591
  Hyper

SEQ ID NO: 127357 - DNA, 34 bp, Homo sapiens; identical to SEQ ID NO: 97107
  chr7:17413242-17413276
  Hypo

SEQ ID NO: 127358 - DNA, 253 bp, Homo sapiens
  chr7:18125972-18126225
  Hyper
gagccacggggggcgcgagagggcgaggcagcggcctggcttctccccagcaccgttctctgtcacggccgccgcctgaccatcaccccgcgcctcgcgtgggcatgtctcgcttcagaaatcccaagtcgtcttaggttccctggtccttcccctgggggggaaaaaaaacgctggtgcagcccagagcccttttccgctccaccccgggatgtcctcgctgccctcccgcctcccgcgcgtccttcccagc

SEQ ID NO: 127359 - DNA, 600 bp, Homo sapiens
  chr7:18126443-18127043
  Hyper
ttttagcaaattctccgcgcgccgccgcccgctcagctcgcagctcgcagccgcccgctgccgccctcccgagccccccccgcgcggcggcggcggcggcggcggcggcggcgcgtcccgcacatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggt

SEQ ID NO: 127360 - DNA, 774 bp, Homo sapiens
  chr7:19145808-19146582
  Hyper
aatccccccattccccgttcccaatctattacatttcaaaggaggagaaagaactggaaaaccccgtttcctttgagaaacgcgtccgcggcagctactgagggtctgccccacctttagcttcaggttgacaactgccttcagcgcgttctcagctcagctggccctatgggtcccctaaaatcgcccgagcgtccgccctgtctgacctgcccccctgccgcggcgcacatttcagcttttcagcttcacggtggagctcgcagtaattgagtcgcgagggttatttttcctggcctcacctcgcggtcctgagcctgcagggagctttcggaaagacatcgccccctccccctgagtccccggcagcttctgaacgctgcgcgggtctccgccccgcgggaaccaggattgcgatccgttcctcggcggctagaggttgaggccggaggctgacaccaccagggacccaacggagggtttattctgcccagcttcacatctgggggtcaaatcgcattaaagccaaaccaccaacggggcagggagcaggtggttaactgcacaaaataaagttacagaaaaaacctcgttttgcaggcgagtgacttagtttccctctgtagctttgccgtcataaaaagcaagtccctcccctctcctgagctggaaggcggggaaaggttatcagcggctccagatggacgcccgtaggcagggtcagtttaggaagaccggcaggcaggcgtattaggcgcgcgggctcccatcctc

SEQ ID NO: 127361 - DNA, 974 bp, Homo sapiens; identical to SEQ ID NO: 97137
  chr7:19146925-19147899
  Hyper

SEQ ID NO: 127362 - DNA, 146 bp, Homo sapiens
  chr7:19152145-19152291
  Hyper
ctagcagcggccagacgcggggctgggggccttccacgcaaaccgaaggagatacggacatcgtcattctccccaccgcgcgagccgggcccgccacccacgcaggggagaccgtgcccgtgcccctctcccgcgcctgccgcagg

SEQ ID NO: 127363 - DNA, 681 bp, Homo sapiens
  chr7:19155963-19156644
  Hyper
acaaaaattgaaagccgaaagaaagggtggcgctgacaaaacggtccttacccgtgaccctgggtgtctctgtctcccctcctgtcacgcacactcacgcgcacacacacccctcaccagggcgcatccccctggagactgctctccctagcggggtcagaccggccttccggggacgctgggggcgcgaggcaacggtgccaagtgaggtgggaaggctgagcggagagtgggagaggggaggaaatcgaggtggactgggaaccgcggcctggccggcctgccgtctgccacctgagaggcgaaggggtgcagcggcgcggtccttacctaggtctccggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactg

SEQ ID NO: 127364 - DNA, 1520 bp, Homo sapiens
  chr7:19156704-19158224
  Hyper
gcccgcagacttcttgccgcgcttgccctgggccgggctgcccggctcgtcgccgcctccgacgcccccacccgcggctccgccgggccccgcgccgccgcccgcgctgcgcctgctgctgcgccgcttgcgtcccccgcgcttgccgctcggcggctgctgccggtctggctcttcctcgctgttgctcaggctgtcgtcggccggcgagactggcgagctggacacgtcctgcatcatctctcgagcggcgacgcgtggcctcgcgggcccggggcagaggagaagagcggggcgcctcagcccgccagcttcccccgcgcgcggcgccggcccgggcgatgcggcccgcggaggagagagcaggaggacggacgggagggacctccgcggggagggcgcgcgggggaggcggggagggaggcgggagggggaggggacggtgtggatggccccgaggtccaaaaagaaagcgcccaacggctggacgcacaccccgccaggcctcctggaaacggtgccggtgctgcagagcccgcgaggtgtctgggagttgggcgagagctgcagacttggaggctcttatacctccgtgcaggcggaaagtttgggggcagcagtgtcattggcctgacgtgaggaggagggacttttcgaagttttataggaaagtttccgctttccagtccccctcccccgtcccacctcccttcctcggggtctaacaattcgtcctcccaaaccattcaaaaacgacctggcccgggcggccggcccctccacccgcctcctagccgccctcccccttccctccccgtcgccttcctccggcgggcgcggggcgatttccttccccgccggagcgtgcgggcagcgcccccgaaccctagcgcagcccaggaagcggtcggaggagactgtcctggccgcggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatttgcgtcccggcctgctctctcgcccttctgggccctcctttcccctctacaacgacccagtctgacgctccccaacatccaaaggactacgcctcggaaggtgctcgaaagaggcagaagttcactcttcggtggaaggaaacccagtccatgggaaaggcagcagagccagaggggggcagcgcagcgcctttgctgcggccctaacagctggcaatgccaacccaagggagagaccctgtggccatttcatccccacccccaaattaggctccgcattgtgaccttg

SEQ ID NO: 127365 - DNA, 99 bp, Homo sapiens; identical to SEQ ID NO: 97148
  chr7:19183647-19183746
  Hyper

SEQ ID NO: 127366 - DNA, 968 bp, Homo sapiens
  chr7:19184058-19185026
  Hyper
caggctttttaaaaacgtaagaatttctactttattatctctatgaaaaaaaaaatgtaaagaagagaggttagattttatagaagctccaaagtctgccatttgcgaggagggttcacttcccacccacccagcccacggaagctcttaggagcagcctgaacggccccgactcagcctcacgctctctgacttccccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctcacccagtgcccggtcctgacacaccccagcactaccagacgaggaagggcagactctccacaccaggctcagccgctttccttcttctcacagctctccaagagctcggtcatgaaggagatatagacgatggccaggcggagggtctcgatccgggacagccttttctcgtaagcaaacgtgggcaccttcctccgcagctggtcaaaggcctcgttgaggttgaacatccgcttcctttcgcggatgttggcggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctgggtcttccctctcggagcgcaagggctgggtcccccaaggagaccccgggtgcgaagtcgcagaggagagggcgtctcggggaggccagggacaggtctgcgacgaagtccagcaccgtagtgtccacgcagctctccggataggccgccatcgcttcggcttggccctgcctctcatcggttttccgcaggg

SEQ ID NO: 127367 - DNA, 30 bp, Homo sapiens; identical to SEQ ID NO: 97159
  chr7:19813245-19813275
  Hyper

SEQ ID NO: 127368 - DNA, 24 bp, Homo sapiens
  chr7:20710238-20710262
  Hypo
aagaagcaagctggccgggtgcgg

SEQ ID NO: 127369 - DNA, 44 bp, Homo sapiens; identical to SEQ ID NO: 97164
  chr7:20719837-20719881
  Hypo

SEQ ID NO: 127370 - DNA, 139 bp, Homo sapiens; identical to SEQ ID NO: 41210
  chr7:20720174-20720313
  Hypo

SEQ ID NO: 127371 - DNA, 30 bp, Homo sapiens; identical to SEQ ID NO: 97166
  chr7:20756837-20756867
  Hypo

SEQ ID NO: 127372 - DNA, 16 bp, Homo sapiens
  chr7:20757821-20757837
  Hypo
gcgcctggcccaaata

SEQ ID NO: 127373 - DNA, 324 bp, Homo sapiens; identical to SEQ ID NO: 97168
  chr7:20816252-20816576
  Hyper

SEQ ID NO: 127374 - DNA, 83 bp, Homo sapiens; identical to SEQ ID NO: 31085
  chr7:20817170-20817253
  Hyper

SEQ ID NO: 127375 - DNA, 754 bp, Homo sapiens
  chr7:20817537-20818291
  Hyper
gaggccctaggatggcgcagggcagcgggctggtgcgggaaaactacagagcaagcgagggagggaagcgaaggcaggggaatccctcaccccgtccggcccgagtgtcttttgagagcccacaggcgagcggggcggggggaggctccccgcgcattcccaccgtgggtttgcccaaggtcagaggcccgggactggcggggcgggtctggccggcattgcccgcgctgagcgcgctgcagaacgggagcagggcacagggtggcgctcgctgtccgtgcagcgggcggaggcggccgcggtgcctttgtgtgcggtgggcgcggcgatgggctgctccggcccgcagcccgaggggagcggcgggcccgggccggggccagggctcgcggggagaccccagaccaccacctcactcttcgctgctacgtgcaagcggaccgtgcggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaagcggcagcccca

SEQ ID NO: 127376 - DNA, 2074 bp, Homo sapiens
  chr7:20823186-20825260
  Hyper
tgctgaaacttgcatcggttccacctcagggaacaaagaaaaagaggcagactgacattgggagatctaaactctacaaactctgggtctcgggctgccaaaagtcacccccaccaagccccgacagcctgagtaggacgtccggcgatgcccaggggcctggcagggtgctccgaagccgaggtgctcagtacagcggctctggaaccaagcagccgtctgcccgggcggcgctgttctgcccaggcctccagcctctccctctccaccgctccgctcaggcttgtcagccgagccgctcctgcccgcgcgaggcccgctgtctaccaggcactggattagtccagctctacctccagtggccgttccctctaaaagttacgcccttcacaacctggggggtggaggaggggaggacaaggaagagagaacgagaaataaaggcccgacgaggcgcgggttccggctgcaacgggttcaggcagcgttacccgtggaaagggaaagccagggcccgggacagcgatgcgtgttacttacttgtccatatcccctttacaaagttaagtcacagaaggaagaaggaagaggggcagaaacagaaagagacagagagcgagtcggatgcaatagggaaaggctggagttgaagtccggacagacagggcccaagaggacttggtgggaggaggtcggggagaggggcgggcgcagggtgggcgtcactctaggccgttgcggtgcccgggctcggggggctgcagcagctctggggagtggcagggcgggctgcccgcggcgctgtgctcgctgtcggtgtcgctgcccttcttgccgccgctgcccgagcccgccgagccgccgccgccgccgccgccactgtgcgtcttcacgtgcttgctgaggtggtcgctgcgcatgaagcgcttgttgcaaactggacaggcgaagcgcttctcgccggtgtgggtccgcaggtgccgctgcagctcgtcggagcgcgtgaagcgcttgccgcagaaaagccagttgcacacgaagggccgctcgcccgtgtgccagcgcaggtgcgccttgaggtgcgaagtcttgccgtacaccttgccgcagcccgggatgtggcagctgtgcaggcccttgcgccgcaagctcgccccggcagggcccagccgctctgcctcctggcagttggggcagtcgcaggtggcgcggccggagtagcggcgagctgaggagcgcggggagccccccagcggcgccgaaggcccagcgctcaacatggagccccccgcgccggccagcggcgacggggccgagtccgggtaggagccgggtagcactggcttgaagccgtccatgaggtgctgcccggcggggctgagcaggtgcgaggaggcgccgctgctgaaggccgagtgactcaggcccgagtaatccgagttgtagcctccgagcggcgagtgcagcgaggtttggagccccccggcggcagggtgcagcgagccgggcagcgcagccgcgctgttcgggttctgcacgtcgatccagccggcccccacgtcccaccagctggaggcgccggccgagcccacctcgcccgcagcacccaggcccgggtgcgagggcttaaaccacgactcgtacgggtgcgccatgcccacccgcgggtagatgccctgcagcccgtccacagaggtgtgcaccttggagatgaacaccggctggtgggagccgtcctgcgagtgcgcggaggagccgccgccgccgcccccgccgccgccgccgctgcccccggaaactccgggggcctggaaaacagagtagtcgttggcgaagggcgagctggaggcggcggctgcggcggcggcggcggcggctgcggcgctgctggaggtgagggagaaggcgctggagccaggcgagccgccgcagctgaacgagtcggacaccagggccgcggcagccgcggctgctgccgcggccgccgcagccgccgaggacgagccgccgttcctggaggccccggacacgccgaagcttgagagactggaacccactacgttgcagctggcgg

SEQ ID NO: 127377 - DNA, 339 bp, Homo sapiens; identical to SEQ ID NO: 97177
  chr7:20826499-20826838
  Hyper

SEQ ID NO: 127378 - DNA, 155 bp, Homo sapiens; identical to SEQ ID NO: 97178
  chr7:20827308-20827463
  Hyper

SEQ ID NO: 127379 - DNA, 34 bp, Homo sapiens; identical to SEQ ID NO: 97179
  chr7:20827523-20827557
  Hyper

SEQ ID NO: 127380 - DNA, 111 bp, Homo sapiens; identical to SEQ ID NO: 97180
  chr7:20828484-20828595
  Hyper

SEQ ID NO: 127381 - DNA, 779 bp, Homo sapiens; identical to SEQ ID NO: 97181
  chr7:20830608-20831387
  Hyper

SEQ ID NO: 127382 - DNA, 454 bp, Homo sapiens; identical to SEQ ID NO: 97182
  chr7:20833089-20833543
  Hyper

SEQ ID NO: 127383 - DNA, 84 bp, Homo sapiens; identical to SEQ ID NO: 97183
  chr7:20834292-20834376
  Hyper

SEQ ID NO: 127384 - DNA, 54 bp, Homo sapiens; identical to SEQ ID NO: 97184
  chr7:20834576-20834630
  Hyper

SEQ ID NO: 127385 - DNA, 30 bp, Homo sapiens; identical to SEQ ID NO: 8910
  chr7:20836099-20836129
  Hyper

SEQ ID NO: 127386 - DNA, 218 bp, Homo sapiens; identical to SEQ ID NO: 97186
  chr7:20836779-20836997
  Hyper

SEQ ID NO: 127387 - DNA, 50 bp, Homo sapiens; identical to SEQ ID NO: 8912
  chr7:20838460-20838510
  Hyper

SEQ ID NO: 127388 - DNA, 30 bp, Homo sapiens; identical to SEQ ID NO: 97189
  chr7:20930367-20930397
  Hypo

SEQ ID NO: 127389 - DNA, 30 bp, Homo sapiens; identical to SEQ ID NO: 97190
  chr7:21006501-21006531
  Hypo

SEQ ID NO: 127390 - DNA, 280 bp, Homo sapiens; identical to SEQ ID NO: 97193
  chr7:21370232-21370512
  Hypo

SEQ ID NO: 127391 - DNA, 30 bp, Homo sapiens; identical to SEQ ID NO: 97194
  chr7:21400528-21400558
  Hypo

SEQ ID NO: 127392 - DNA, 932 bp, Homo sapiens
  chr7:21582520-21583452
  Hyper
tcgggacctagagcccgagggcctctcccctcggccttggccttggcgtatactgggcggtggcgcggtgcgctcactccgcccccagcgggctggggcggggacaccgtcccccgggaaacgggacgcgctgcttgtcccaggccttcgcttcggcctgcgaggctacagctgtgcgcagtggcgcggctgctaagtagcagcaggtgggagactagggtctgcgctcgcggcgaccgcggaggagggtgggcgcctgcggaggtgtcctcgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagtcgctcccctttggattcccgcggggcgctcactcgggcactttaacaaacttggcttgaagtccccatcctgaggcccgcaggactcctccccacgtgcacccactctgcagttcagcagctgcaggttagtttcctaagtcagcagtttgtatctgaccgagaatcccgcgtt

SEQ ID NO: 127393 - DNA, 57 bp, Homo sapiens; identical to SEQ ID NO: 97199
  chr7:21690874-21690931
  Hypo

SEQ ID NO: 127394 - DNA, 95 bp, Homo sapiens; identical to SEQ ID NO: 97206
  chr7:22539833-22539928
  Hyper

SEQ ID NO: 127395 - DNA, 28 bp, Homo sapiens
  chr7:22540572-22540600
  Hypo
gcgtgagccaccgcgcccagccacctta

SEQ ID NO: 127396 - DNA, 657 bp, Homo sapiens; identical to SEQ ID NO: 97208
  chr7:22589295-22589952
  Hyper

SEQ ID NO: 127397 - DNA, 30 bp, Homo sapiens; identical to SEQ ID NO: 97211
  chr7:22893577-22893607
  Hyper

SEQ ID NO: 127398 - DNA, 173 bp, Homo sapiens; identical to SEQ ID NO: 41212
  chr7:22981026-22981199
  Hypo

SEQ ID NO: 127399 - DNA, 30 bp, Homo sapiens; identical to SEQ ID NO: 97214
  chr7:23009058-23009088
  Hypo

SEQ ID NO: 127400 - DNA, 53 bp, Homo sapiens; identical to SEQ ID NO: 97215
  chr7:23053027-23053080
  Hyper

SEQ ID NO: 127401 - DNA, 16 bp, Homo sapiens
  chr7:23129478-23129494
  Hypo
ccgtctcaaaaaaaaa

SEQ ID NO: 127402 - DNA, 30 bp, Homo sapiens; identical to SEQ ID NO: 41213
  chr7:23220685-23220715
  Hypo

SEQ ID NO: 127403 - DNA, 78 bp, Homo sapiens; identical to SEQ ID NO: 97218
  chr7:23223070-23223148
  Hypo

SEQ ID NO: 127404 - DNA, 448 bp, Homo sapiens
  chr7:23287206-23287654
  Hyper
agcagtgtgcagattcgcgagaggaagagagctgagccgctgtaaccctgggcctgggattgcggggacgggacgggtgggaagcggccaaaggcgcagcggcttctggtcagagccgcagaggcctgagacgtgggccgcgccccggcccaggagaccccgcggccgcgccctaaccctcagtctcccgactgcgactgcgacccgggaaaacgcctacgtttttggaaaggaagtcccatcacagggagctgacccggtgtcagcgcgcagcacgttcccggcccgcagtgcgccgcgcgtcctcctagcagcccgcggagcccggcactgtgatggtcccgcttcccacacgaggccacgggccacagagtgggcaaggaactcgccccaagccacacagcgggtaagttgaggaggcagccttccatcccgacctctgtccttc

SEQ ID NO: 127405 - DNA, 30 bp, Homo sapiens; identical to SEQ ID NO: 97221
  chr7:23340392-23340422
  Hypo

SEQ ID NO: 127406 - DNA, 1745 bp, Homo sapiens; identical to SEQ ID NO: 97223
  chr7:23508102-23509847
  Hyper

SEQ ID NO: 127407 - DNA, 183 bp, Homo sapiens; identical to SEQ ID NO: 97224
  chr7:23510841-23511024
  Hyper

SEQ ID NO: 127408 - DNA, 951 bp, Homo sapiens; identical to SEQ ID NO: 97225
  chr7:23513474-23514425
  Hyper

SEQ ID NO: 127409 - DNA, 136 bp, Homo sapiens; identical to SEQ ID NO: 97226
  chr7:23514666-23514802
  Hyper

SEQ ID NO: 127410 - DNA, 33 bp, Homo sapiens; identical to SEQ ID NO: 97227
  chr7:23525018-23525051
  Hypo

SEQ ID NO: 127411 - DNA, 30 bp, Homo sapiens; identical to SEQ ID NO: 97228
  chr7:23553199-23553229
  Hypo

SEQ ID NO: 127412 - DNA, 30 bp, Homo sapiens; identical to SEQ ID NO: 41215
  chr7:23568103-23568133
  Hypo

SEQ ID NO: 127413 - DNA, 138 bp, Homo sapiens; identical to SEQ ID NO: 97230
  chr7:23569163-23569301
  Hypo

SEQ ID NO: 127414 - DNA, 34 bp, Homo sapiens; identical to SEQ ID NO: 97231
  chr7:23578823-23578857
  Hypo

SEQ ID NO: 127415 - DNA, 125 bp, Homo sapiens; identical to SEQ ID NO: 97232
  chr7:23719533-23719658
  Hyper

SEQ ID NO: 127416 - DNA, 123 bp, Homo sapiens; identical to SEQ ID NO: 97233
  chr7:23749706-23749829
  Hypo

SEQ ID NO: 127417 - DNA, 120 bp, Homo sapiens; identical to SEQ ID NO: 41219
  chr7:24099277-24099397
  Hypo

SEQ ID NO: 127418 - DNA, 30 bp, Homo sapiens; identical to SEQ ID NO: 97236
  chr7:24323498-24323528
  Hyper

SEQ ID NO: 127419 - DNA, 60 bp, Homo sapiens; identical to SEQ ID NO: 97237
  chr7:24324091-24324151
  Hyper

SEQ ID NO: 127420 - DNA, 21 bp, Homo sapiens
  chr7:24580785-24580806
  Hypo
ccttcgcgcccagccacaatc

SEQ ID NO: 127421 - DNA, 61 bp, Homo sapiens; identical to SEQ ID NO: 97240
  chr7:24749659-24749720
  Hypo

SEQ ID NO: 127422 - DNA, 224 bp, Homo sapiens; identical to SEQ ID NO: 41221
  chr7:24761204-24761428
  Hypo

SEQ ID NO: 127423 - DNA, 180 bp, Homo sapiens; identical to SEQ ID NO: 97242
  chr7:24771552-24771732
  Hypo

SEQ ID NO: 127424 - DNA, 1278 bp, Homo sapiens
  chr7:24796332-24797610
  Hyper
ccctcggggtgcagacggcaagcggctctggaaagggtcagaggtcctcaaatggagaccaaaggaagccacgcgggcagctcttgagagccattccagcgcatgccaggcacaccgagtggggcttggcctcctccccaagctaggagctctctagataccggagcaaagtggagggggacttttttccgtccagagagactgaactccgtatctgttccgcggtccgcctccctgcacacacgcccccgagccgggagagcctccgcagcacccagagaagagaccggaacacaaaggatgaacgaatggggagggggggtttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctcccctaggaaggagcgaggggagggtggcccagagagaaagcgccgcgcggcctcggctgcccccggcccgggacacccaaacagaccaaagaggatccggagtggagcccggagcggatcccgcagcccgcgcccgccgcgcacttacccgcgcgcccgctgctgggtccccggcagccgcgccccctgcgctggcggagtcggaggagcctgcgctgggccggcggggggcgggcgcttggggagggcggagagagggcccgcccgccgggacctttgctcggtccgggcgccccagagccgcgggactggccgccggaggctgcgggaggggcccgggccagacctcccagaagccccagagagagccgcttcccctccttcgtgtgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacggttcaaccaggaaagtccaaggcctgtccagcctgtgggagcccctaatgcccgtgcctggagtagtatctgggtgtgtggtgcgacagtgcccacacttaggcctgccgctaatcagtgatt

SEQ ID NO: 127425 - DNA, 30 bp, Homo sapiens; identical to SEQ ID NO: 41222
  chr7:24799881-24799911
  Hypo

SEQ ID NO: 127426 - DNA, 30 bp, Homo sapiens; identical to SEQ ID NO: 41223
  chr7:24845483-24845513
  Hypo

SEQ ID NO: 127427 - DNA, 124 bp, Homo sapiens; identical to SEQ ID NO: 97251
  chr7:25100258-25100382
  Hypo

SEQ ID NO: 127428 - DNA, 42 bp, Homo sapiens; identical to SEQ ID NO: 97252
  chr7:25132402-25132444
  Hypo

SEQ ID NO: 127429 - DNA, 31 bp, Homo sapiens; identical to SEQ ID NO: 97253
  chr7:25133418-25133449
  Hypo

SEQ ID NO: 127430 - DNA, 120 bp, Homo sapiens; identical to SEQ ID NO: 97255
  chr7:25165828-25165948
  Hypo

SEQ ID NO: 127431 - DNA, 197 bp, Homo sapiens; identical to SEQ ID NO: 97256
  chr7:25335888-25336085
  Hypo

SEQ ID NO: 127432 - DNA, 190 bp, Homo sapiens; identical to SEQ ID NO: 41224
  chr7:25495487-25495677
  Hypo

SEQ ID NO: 127433 - DNA, 84 bp, Homo sapiens; identical to SEQ ID NO: 41225
  chr7:25530809-25530893
  Hypo

SEQ ID NO: 127434 - DNA, 30 bp, Homo sapiens; identical to SEQ ID NO: 97261
  chr7:25569127-25569157
  Hypo

SEQ ID NO: 127435 - DNA, 20 bp, Homo sapiens
  chr7:25603450-25603470
  Hypo
gatttgggccaggtgcggtg

SEQ ID NO: 127436 - DNA, 186 bp, Homo sapiens; identical to SEQ ID NO: 41226
  chr7:25802276-25802462
  Hypo

SEQ ID NO: 127437 - DNA, 297 bp, Homo sapiens; identical to SEQ ID NO: 31119
  chr7:25891946-25892243
  Hyper

SEQ ID NO: 127438 - DNA, 78 bp, Homo sapiens
  chr7:25892510-25892588
  Hyper
ccctcgccctgggaccgttgcccctgcgcccgccgccctgtgcctgggcctttgcacccggagcgccccgcgccccag

SEQ ID NO: 127439 - DNA, 384 bp, Homo sapiens; identical to SEQ ID NO: 97270
  chr7:25896230-25896614
  Hyper

SEQ ID NO: 127440 - DNA, 264 bp, Homo sapiens; identical to SEQ ID NO: 97271
  chr7:25896674-25896938
  Hyper

SEQ ID NO: 127441 - DNA, 32 bp, Homo sapiens; identical to SEQ ID NO: 97272
  chr7:25902106-25902138
  Hyper

SEQ ID NO: 127442 - DNA, 304 bp, Homo sapiens; identical to SEQ ID NO: 31122
  chr7:25902345-25902649
  Hyper

SEQ ID NO: 127443 - DNA, 218 bp, Homo sapiens; identical to SEQ ID NO: 97274
  chr7:25990010-25990228
  Hyper

SEQ ID NO: 127444 - DNA, 63 bp, Homo sapiens; identical to SEQ ID NO: 97276
  chr7:26192685-26192748
  Hyper

SEQ ID NO: 127445 - DNA, 40 bp, Homo sapiens; identical to SEQ ID NO: 97277
  chr7:26217186-26217226
  Hypo

SEQ ID NO: 127446 - DNA, 17 bp, Homo sapiens
  chr7:26222458-26222475
  Hypo
gctggagtgtggcagcg

SEQ ID NO: 127447 - DNA, 120 bp, Homo sapiens; identical to SEQ ID NO: 97279
  chr7:26283695-26283815
  Hypo

SEQ ID NO: 127448 - DNA, 781 bp, Homo sapiens; identical to SEQ ID NO: 97280
  chr7:26415774-26416555
  Hyper

SEQ ID NO: 127449 - DNA, 37 bp, Homo sapiens; identical to SEQ ID NO: 97281
  chr7:26437864-26437901
  Hyper

SEQ ID NO: 127450 - DNA, 30 bp, Homo sapiens; identical to SEQ ID NO: 97282
  chr7:26439820-26439850
  Hypo

SEQ ID NO: 127451 - DNA, 23 bp, Homo sapiens
  chr7:26513167-26513190
  Hypo
agttttgatattggtcgggggca

SEQ ID NO: 127452 - DNA, 81 bp, Homo sapiens; identical to SEQ ID NO: 97285
  chr7:26555405-26555486
  Hypo

SEQ ID NO: 127453 - DNA, 165 bp, Homo sapiens; identical to SEQ ID NO: 97287
  chr7:26652551-26652716
  Hypo

SEQ ID NO: 127454 - DNA, 35 bp, Homo sapiens; identical to SEQ ID NO: 41231
  chr7:26762298-26762333
  Hypo

SEQ ID NO: 127455 - DNA, 30 bp, Homo sapiens; identical to SEQ ID NO: 97290
  chr7:26979426-26979456
  Hypo

SEQ ID NO: 127456 - DNA, 44 bp, Homo sapiens; identical to SEQ ID NO: 97292
  chr7:27128016-27128060
  Hyper

SEQ ID NO: 127457 - DNA, 1524 bp, Homo sapiens
  chr7:27135266-27136790
  Hyper
acacccccaggttcccggaagtctggtaggtagccggctgggggtggcgatggtggtggtggtggtggtggtggggcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttct

SEQ ID NO: 127458 - DNA, 1128 bp, Homo sapiens; identical to SEQ ID NO: 97297
  chr7:27190145-27191273
  Hyper

SEQ ID NO: 127459 - DNA, 77 bp, Homo sapiens; identical to SEQ ID NO: 97298
  chr7:27191507-27191584
  Hyper

SEQ ID NO: 127460 - DNA, 1052 bp, Homo sapiens
  chr7:27195586-27196638
  Hyper
atgctatgggctccacgcaatggcgcctccgctccaattaaaaccagaaaggctgcgccgggagtcacggggctaccggctcgcaacagcctggctccgctcttccggccccgcgccccgcgctccgcgctccccagcgctgcgctccccgctcccggtcccgctccgccagcctggcccgcctagcgactgcgcctacctgaagaccgcatccaggggtagatgcggaaattggcctcagccgcgccatgcagcgcgccctcgtccgtcttgtcgcaggcgcctttggcgaggtcactgcagagcccggggatgttttggtcgtaggaggcgcagggcaggttgccgtaggcgtcggcgcccaggccgtagccggacgcaaaggggctctgataaagggggctgttgacattgtataagcccggaacggtcgaggcgaaggcgccggcgcccgccccgtagccgcttctctgtgagttgggagcaaaggagcaagaagtcggctcggcattttggaacagagaagcccccgccgtatatttgctaaaaagcgcgttcacataatacgaagaactcataattttgacctgtgatttgttgtccggcagctttcagtgtcggttttacgaggtagagtgatatatgataacattacacccccagatttacaccaaaccccattttcttttggacggagctcgccgcagcacgtgaccgcccacatgaccgcctccgccaatctcagcagtcctcacaggtggtctcgctccgcagggcccgcagccgcctagaatggaagggcaagaggctcaaatatgcggccaaagaatccgcccgcgcccggcgggcctggcgcgtcccgcggaaaaagacctggaggctccgcgggagcgcccagctggcggccaacctccgcactggggtctgcggacgccaggcggcccggccccacgcagcaccccccaccccgcccccccgccgactcctgctagtgagccctggaccaagcttgggatcctccccatccctctcctgtccgcctgcccagaccc

SEQ ID NO: 127461 - DNA, 30 bp, Homo sapiens; identical to SEQ ID NO: 97305
  chr7:27204111-27204141
  Hyper

SEQ ID NO: 127462 - DNA, 1674 bp, Homo sapiens
  chr7:27204384-27206058
  Hyper
tcgagaggcttccagcgaggacgaaggcaggctcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccggcgccgccgccgccacgggcgcctgggggtgcacgtaggggtggtggtgatggtggtggtacaccgcagcgggtacagcgttggcgcccgccgcgtgcactgggttccacgaggcgccaaacaccgtcgccttggactggaagctgcacgggctgaagtcggggtgctcggccagcgtcgccgcctgccggggaggctggcccagggtccccggcgcatagcggccaacgctcagctcatccgcggcgtcggcgcccagcaggaacgagtccacgtagtagttgcccagggccccagtggtggccatcaccgtgcccagcgcctggcccgcccggcccgacccacggaaattatgaaactgcagatttcatgtaacaacttggtggcaccgggggggaagtacagtcacctaataagttgccggcgcccgcgcccccattggccgtgcgcgtcacgtgcccgtccagcagaacaataacgcgtaaatcactccgcacgctattaatggtccgatgttttgcagtcataatttttatagcaaaagccatatgtttttatgtaaagggatcgtgccgctctacgatggggtttgttttaattgtggccaacgacgattaaaagatcaaatctagccttgtctctgtactctcccgtctccccccccatacacacacttcttaagcggactattttatatcacaattaatcacgccatcaagaaggcgcgggtcccgcgtgcgagtgcggccagcggagcccctcacataaaattagacaataattgaagccataaaaaagcagccaaatcgcattgtcgctctactgtatttaaatctatatttatgatatttcataaggagttattgtttcagaagccacacaggctggcgggaagtcggaaacgaccaacagattcgtttgcctcgccgtggctcccagctgtaaaaatttacgaggacttggaaaggttagactgttgtgtttggttggcgagctccctgtaaataatccctgcggtccccgggagaggcgagtttacccgcggccgccctcgaaaagtcaaattcaacgcaggatccgtcccaaacggagccgccgccggccctaccagggcactccaggcagggaccggccgctcagggagtaccgcgggtgtaggtccccacagctacccgcctggagcgaggggcgcccgggcaacccttaaattcgcctttgctacgaggaccccacggaggagctggccaggagggagcggccagccgccaccagggcgaaggttttgaggg

SEQ ID NO: 127463 - DNA, 36 bp, Homo sapiens; identical to SEQ ID NO: 97309
  chr7:27208865-27208901
  Hyper

SEQ ID NO: 127464 - DNA, 178 bp, Homo sapiens; identical to SEQ ID NO: 97310
  chr7:27209503-27209681
  Hyper

SEQ ID NO: 127465 - DNA, 2050 bp, Homo sapiens
  chr7:27212347-27214397
  Hyper
atagctgggcgattccgaggtccaggggaagggaaatggcccttctctggctctcagctcagggccccccgcttccaggccggatttgccttttcttcttcccgcaacgaagattcccgcccctcagcaactttgaaaaaagcatgggggatcgtaaactcgaacttcgccggttaatgggcttatttattggcgctggcggctgcttattttggatgccttacaaacatccgcgctatctgcgggcgagctactttccctccctccccctccccccgcgtgggccgcgccgcgcaggctgggcagggaccagggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctccggcgaggctttgctgctctcggaaggggccggggagagctcctccgcggccgaggacgacgcgtgcgcctcctcgtcgccctgcgagcccccgccgctgccgcaagccagcgtggggggcggcggcgaatcgagggctcgctccttccgggccgcatcggccgagccggaggctagcgcgggcgggagatcgaaaccgcgccccgggggctgcgcggggaacgggccagccccgagttgctgcgcgccgccgccgccgctgccatagcccttggcggtgccgtaggcctgagaaaggcggaagtagccaggcactggcaccccgctggaggtgcccagggcgcagccgtcgggcggcgggccccgcgggaagggagccagttcggcggcggtggccgagactttggggcatttgtccgccgagtcgtagaggcagtaggagctctcttctttgatgttctgcgcgaaagagcacgaggtggcctgcggcgctggctggggtggttgcggcgggggcggcggctgctgctggggcggcggcggcggcccgtcaggcggctccatccggcaagaccggggcgcgtctagccacaggtctatgggcgagggcccgtagccgtgcgccccgggacctagacccccgccaccgccaccgctgcccggcgacgctgcctcattgcgcttgccgcccagcgtggggaagagcccgcagctctgcagcccgtagggcaggtcggcggcgggcggcaggtagaccccgccgtgggcgtagtaaccgccaccgccgccgccccccgcgccaccaccaccgccgcctgcctcgcctctgcccgagctgatgagcgagtcgaccaaaaaagagttcgcggcggggctctccgagcatgacattgttgtgggataatttggcgaagggagcagatagccctttctggctgacatttcttgtgcaaaacatgctgaatacgattagcaatccccccgcaccgcggcgggcgcccgcagccaatcccgagccagagtttccgcgcgaccactcccagtttggtttcgtaggcgcggggccgctctccgagggcgccctcagagcccgcgattgatataaatatgtaatctgtattgatgggccaggagacgcaccccgacaccttggcccgaaggccgggagctgtgggggctgccccaacgtggctggtggggggcctggccattgggctcgccccgcccctacccggacgtgagccccataccggggtcccttagaagggcccttgggccccgcgcagttaacaagtggggtgtttatggtgcgcgcccagtctgccttgggtgctcaccatccctgtcgcagaagctgccactagtccccggtgtactctaaccactgaagcggccgtgtcggggactcacgcgc

SEQ ID NO: 127466 - DNA, 524 bp, Homo sapiens; identical to SEQ ID NO: 97315
  chr7:27219320-27219844
  Hyper

SEQ ID NO: 127467 - DNA, 192 bp, Homo sapiens
  chr7:27223114-27223306
  Hyper
ccttaacatctggggcggctgccgggtctttgtcagcctgagtcctggccaccagcttctgcctccccggccagccttccggctccgccgaggtggggaggtggcggcggaagccccctaccctaggccttcgctgagcaccacggccacacggccatcctgcacacggcagagcagcggctctatcttagg

SEQ ID NO: 127468 - DNA, 1583 bp, Homo sapiens
  chr7:27223574-27225157
  Hyper
actttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacgtaagctgacgtggaaatctatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagca

SEQ ID NO: 127469 - DNA, 268 bp, Homo sapiens; identical to SEQ ID NO: 97319
  chr7:27227776-27228044
  Hyper

SEQ ID NO: 127470 - DNA, 52 bp, Homo sapiens; identical to SEQ ID NO: 97320
  chr7:27228676-27228728
  Hyper

SEQ ID NO: 127471 - DNA, 887 bp, Homo sapiens; identical to SEQ ID NO: 97321
  chr7:27232211-27233098
  Hyper

SEQ ID NO: 127472 - DNA, 30 bp, Homo sapiens; identical to SEQ ID NO: 31155
  chr7:27237273-27237303
  Hyper

SEQ ID NO: 127473 - DNA, 30 bp, Homo sapiens; identical to SEQ ID NO: 97323
  chr7:27237530-27237560
  Hyper

SEQ ID NO: 127474 - DNA, 179 bp, Homo sapiens; identical to SEQ ID NO: 97324
  chr7:27237991-27238170
  Hyper

SEQ ID NO: 127475 - DNA, 410 bp, Homo sapiens; identical to SEQ ID NO: 97325
  chr7:27238507-27238917
  Hyper

SEQ ID NO: 127476 - DNA, 1183 bp, Homo sapiens
  chr7:27239141-27240324
  Hyper
gcccatgcgggcgcacgggtagtagccgctgccgaagtagccatagggcagcgccgcgggccccgacgagctctgcgccgctgccgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccggcccccccgctccgcccacggcgtatgcaaagcgggcggctccgactccagctctgcacggtgcacccgtcgtccccgccgcggcccgcgccgtccccagcgccagccgcgcggccgcgcaccattcacccgggggagaggcggaggaacgtgcgggtggggcagggaaggaaggcggccccatctccgccccccttcccttcctttatcccagtggggcccagacccgcgcaaccaggcggggaggggaggtgggcgcgcgattgggttgcgatctggagcagtggggacaggtcaggtaattctgccggcggtcagggatgggagagtggggaggacgggaccagcctagctcagaatgggtgtttcttggagcctctgggactgttttctttccaggaaccggcgcgtatttctgcagtgagaccacaggacggacatcggcgccttcggcttcgatggagttgcgattttgctctttc

SEQ ID NO: 127477 - DNA, 181 bp, Homo sapiens; identical to SEQ ID NO: 31161
  chr7:27240992-27241173
  Hyper

SEQ ID NO: 127478 - DNA, 32 bp, Homo sapiens; identical to SEQ ID NO: 97329
  chr7:27242143-27242175
  Hyper

SEQ ID NO: 127479 - DNA, 771 bp, Homo sapiens
  chr7:27244539-27245310
  Hyper
actcctcagagctggcgcaaactccgtcctccaaaactcggctctgggaggcctaagtgactccgaagccggcggcagccgcggcagcggccgtggtggtggaagagctcttttccccgacagtgccactgatcgctcttcactggagctggaaacagccttcgcggaaaggaccggagcatgcgttagaagcagagggagcttggtgaagggctcggctggaaggaggaaacgccttctcgcagtgcgcggccagcccgcgggggacaccggcttgctggactgcaggggcccgtgccacccaggaagtgacctgcgggtcactcagccggggcgctgggcgagcgcgggacggcccggagaattccgtgcggctgcgacgggaaaaggacgaggggtctctgtacccgacgctgccactggcccaaaggaattttacccgcgagcgcccaccccaccctagcttgatgcttacgcccgcaacaaaacaggaaaccaggactgggcagtgcattctttaagtcaacaaatacactgaagacttcgagcgtttgaaggaaggagggggtttgcacgtaagcctggccccgccgggctcggctttctcgctgagaaagcggcgcaggcagccaggcggcctgggcccgcgggggtccatctcgccctagactcctaagaactcccacggccctgttcccagctgcgaattcttaatgcacaacgcgacggagggaaggaaattcaccagcgcagcgacgaggaaggggaact

SEQ ID NO: 127480 - DNA, 114 bp, Homo sapiens; identical to SEQ ID NO: 97332
  chr7:27245526-27245640
  Hyper

SEQ ID NO: 127481 - DNA, 165 bp, Homo sapiens; identical to SEQ ID NO: 31165
  chr7:27250066-27250231
  Hyper

SEQ ID NO: 127482 - DNA, 822 bp, Homo sapiens
  chr7:27252370-27253192
  Hyper
acctcttcaggcgaccgcacccttccgctgaagtcccccacttctgcccctccgaggtggggtgggggtgttctgaaataacggtggctgcagttagatggctgaggacatagaaagcggttgttatttattccaggcaccatcacaaaaggcttccaaaaatatcgagccgagatattttattgtccagcctgtctgcagcctgtaattatgcgttcaagatgtttaatgtgtgcaaatgcattagccgctttcgctggtgaaaaccctagctgggggcggggtagaggcaagtctggagataattatgtcgtacagtcgcaaacattattccgttcttactgtaaacggccccggccacctttacgagaaaccaggaaacttctgagagttactagcagcgtttacgcgggcaaactgagttctttttctttctctcccggattgttcgaagtatctatcgggcggcttcgatgccaggttcagaggcgcgccagggagagggcgccccgcagaggagcgcagcggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggcccgcgagcagttctcgaaaggtgcggact

SEQ ID NO: 127483 - DNA, 1013 bp, Homo sapiens; identical to SEQ ID NO: 97336
  chr7:27264571-27265584
  Hyper

SEQ ID NO: 127484 - DNA, 480 bp, Homo sapiens
  chr7:27274962-27275442
  Hyper
acctatcacccatcccgcttagggtccagctcagagagcgggcgcatagggcctggtggaacaggctgccctctggggatgggggattggggccgctgctccgggcagagccgcgggatccgagccagcaaggatgctgggactcgccgcgacttccgcctctggcgatcggcagtggggggcgcaccaagacagcagttcgggagctgcgctttgtcaccgaggcggcgaggggcggagggcgcagaaaggggccgcggagaaaggacaaggcggccgaccagctcccaggatggaaagggaccctcaaggggctccaggcagcacctggggcaaggggagggactgatactcccggccggagcccaacctgtggcgcgtgcttcagtcctgagccagcggctccctggcttctgggctggcatccgtcctaccctcctcccgctgcaacacgcccctgatagccgctcccccaccctc

SEQ ID NO: 127485 - DNA, 594 bp, Homo sapiens
  chr7:27279065-27279659
  Hyper
gcgggccatctcccccgagccgggcgggcagactgcggaggcaggccccacacgcgccgcttttccgagcccggttttcttcaggagcgaagctgttccagctgacccgcgcgtctgggggcctatgcccggcttccgattccatttaaaacgacccgcgcatcttatctccgtcgcctccccggggttcccacccacccccctccggcccgggccaggccagcccagccccggcggaagccaagctgggagcttttgaagtccggagaatttcaatccgagaggagccggctggaccggagcccgtcgccccagcgggggaagggacggggggcctgccgtgtggcaggtgggggatgggtgtcccccgccgcgagaaatgagaagccgccgggcctggagcggcctccacctcagctgctatcaccccctctccgctgtcatgggattgcccaggcttaatggggttgtgcagggcttcacttgctctcggaatttaccttccttctcgagccgtgccgcgaataaccttcacgacacagtgataacgatgttattaaatactccccccacattcaccgcccaaaaaaccaa

SEQ ID NO: 127486 - DNA, 1627 bp, Homo sapiens
  chr7:27281948-27283575
  Hyper
ttgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgctgagggggcggatgcaagtcctggacttgggggattcgaagctcaccccaagcacccagtgtttcaactgctcggggaatgcttcaattgctcggggaagacactttccccaggcgagggcaagatcaaacgccgatccgggcagtttgtggctggcagggtgtaagaggcatggaggcgcggaagccaggagtccataaaggaccgtaaaattgcggcccacttgggcagcccgggtgctgcagccctccgaccagtttgcacgtcggtcagaggtccaa

SEQ ID NO: 127487 - DNA, 219 bp, Homo sapiens
  chr7:27284655-27284874
  Hyper
tcgctgtgcagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcg

SEQ ID NO: 127488 - DNA, 707 bp, Homo sapiens
  chr7:27285445-27286152
  Hyper
ctggcctctgagcatcgggccaagtccagctactgaacctgctccgctcctctccccaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgcc

SEQ ID NO: 127489 - DNA, 620 bp, Homo sapiens
  chr7:27288946-27289566
  Hyper
acagctattagtggccgatgtagctatgagctccgggctcccacttcctcttctcttaccctgttctggggcacagattctgaggtaacccccagtgaagcctgacacctcactcccgactcacgctttcccagggctcttcaatcccggccagccggcagggcctgggagcgcggtccagcgcccagcccagattcgcccagttgggcaaggctggccaccccgcagcccgagtgtgcaccggcccccggcaattgctggcttgttagcgtgtgattgattgccttattaaagcgtgttcttgtaagtgtgaccaaactgattgcattgcatatgtttgggataatgctcattttaaacaacaggataaagaggatgagctccgcagagccttgaagacaaaatgattctggctagcagctccctaactatggcattaaattgctcagttacatagcaaatcgctacttggtttctgcatccttgtccgtattttttttttttctgtcctacagtttgatcctgtctcccaatgtggcatgccccacgaacggtttctttagtgattatgttgactccaccttcctagtttcaaaccctgcacccgcactctccagaca

SEQ ID NO: 127490 - DNA, 93 bp, Homo sapiens; identical to SEQ ID NO: 97346
  chr7:27289789-27289882
  Hyper

SEQ ID NO: 127491 - DNA, 1232 bp, Homo sapiens
  chr7:27290946-27292178
  Hyper
aaagtcatatccttgcgtcttcatcgagattatttatagcgcagtgagcgctgctgaaaggtatacgctgttaacagggacaattacttaaagggaagcgtttgtaaaatggaaaacaaatgccggggttggtaacaaatgggatcaaaagcagccattccaatctggctccccgagggaaaggagcgggcgtggccctgtaggattaggggcgcttctgacctccccaagacccaggtgaggccgagggtccccggcgcgccagcctgcgccgtggctgtggctgcggtggcgactcgggccgggcctcgctctcgccggcttcaggttcccgcctccctcgcgcaggcagcgggcgcgtgtggcccgggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacg

SEQ ID NO: 127492 - DNA, 56 bp, Homo sapiens; identical to SEQ ID NO: 97351
  chr7:27531197-27531253
  Hypo

SEQ ID NO: 127493 - DNA, 203 bp, Homo sapiens; identical to SEQ ID NO: 97352
  chr7:27555618-27555821
  Hypo

SEQ ID NO: 127494 - DNA, 30 bp, Homo sapiens; identical to SEQ ID NO: 97353
  chr7:27591774-27591804
  Hypo

SEQ ID NO: 127495 - DNA, 47 bp, Homo sapiens; identical to SEQ ID NO: 97354
  chr7:27686768-27686815
  Hypo

SEQ ID NO: 127496 - DNA, 32 bp, Homo sapiens; identical to SEQ ID NO: 41235
  chr7:27903816-27903848
  Hypo

SEQ ID NO: 127497 - DNA, 67 bp, Homo sapiens; identical to SEQ ID NO: 97357
  chr7:27905659-27905726
  Hypo

SEQ ID NO: 127498 - DNA, 242 bp, Homo sapiens; identical to SEQ ID NO: 97358
  chr7:27907826-27908068
  Hypo

SEQ ID NO: 127499 - DNA, 99 bp, Homo sapiens; identical to SEQ ID NO: 97359
  chr7:27916674-27916773
  Hypo

SEQ ID NO: 127500 - DNA, 30 bp, Homo sapiens; identical to SEQ ID NO: 97360
  chr7:27980078-27980108
  Hypo

SEQ ID NO: 127501 - DNA, 24 bp, Homo sapiens
  chr7:28049405-28049429
  Hypo
tcaccattgcgttttttaaaaatg

SEQ ID NO: 127502 - DNA, 116 bp, Homo sapiens; identical to SEQ ID NO: 97363
  chr7:28050616-28050732
  Hypo

SEQ ID NO: 127503 - DNA, 30 bp, Homo sapiens; identical to SEQ ID NO: 41239
  chr7:28055637-28055667
  Hypo

SEQ ID NO: 127504 - DNA, 30 bp, Homo sapiens; identical to SEQ ID NO: 97365
  chr7:28241732-28241762
  Hypo

SEQ ID NO: 127505 - DNA, 128 bp, Homo sapiens; identical to SEQ ID NO: 97366
  chr7:28258505-28258633
  Hypo

SEQ ID NO: 127506 - DNA, 24 bp, Homo sapiens
  chr7:28310468-28310492
  Hypo
acagaatgagtccagcgggcctga

SEQ ID NO: 127507 - DNA, 183 bp, Homo sapiens; identical to SEQ ID NO: 97368
  chr7:28351972-28352155
  Hypo

SEQ ID NO: 127508 - DNA, 25 bp, Homo sapiens
  chr7:28366473-28366498
  Hypo
tatttaggctgggtgcggtggctca

SEQ ID NO: 127509 - DNA, 1539 bp, Homo sapiens
  chr7:28448701-28450240
  Hyper
ctaatgtcagggagccgtgtcacacggcgctgggctctgcaagctgttgcttgcgcagtcgcccccgccgctgccgctcccgggcgggtgcaccagggtccgcgcgggcggggcggggtcggggcgggaccggggcggggcctgccccctcgacgcgccggccccgcccctcgctccgtccctccccagcggaccgcaatgatttagaagttcaggaatcccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccccgagtgctggtagactgtggaattcggctgtgtcctgaggccaccctagagaccccgcgccgcgtgagtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggcgcgcgcgcagggggctcgctctccccggtgcggagctgcagctgccacctctcccgccgggctgccggctgcagcgggtgggcgcgcgcccggggaggggaggtcgccctcggagggcgcttggctttcgctccaggcgctccgggctggagagcggcgaggctccgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcggcagaatcacttgaacttttcacgaagttcttagaggggcaagatgcgaaggaaggaaccaaggagatgttttctctcagcagctgcatcccgcttcttctttgccatagatttatttttaaggggcgtctggtagataaagccctagaccttgtccacactctcacccccatccccaactttccctggaccggtgccgcccccacttgatg

SEQ ID NO: 127510 - DNA, 99 bp, Homo sapiens; identical to SEQ ID NO: 97373
  chr7:28450611-28450710
  Hyper

SEQ ID NO: 127511 - DNA, 30 bp, Homo sapiens; identical to SEQ ID NO: 97374
  chr7:28535177-28535207
  Hypo

SEQ ID NO: 127512 - DNA, 21 bp, Homo sapiens
  chr7:28571358-28571379
  Hypo
ctgaggctagccgggcgtggg

SEQ ID NO: 127513 - DNA, 30 bp, Homo sapiens; identical to SEQ ID NO: 97376
  chr7:28572177-28572207
  Hypo

SEQ ID NO: 127514 - DNA, 30 bp, Homo sapiens; identical to SEQ ID NO: 97379
  chr7:28887552-28887582
  Hypo

SEQ ID NO: 127515 - DNA, 221 bp, Homo sapiens; identical to SEQ ID NO: 31183
  chr7:28893380-28893601
  Hyper

SEQ ID NO: 127516 - DNA, 197 bp, Homo sapiens; identical to SEQ ID NO: 97381
  chr7:28907350-28907547
  Hypo

SEQ ID NO: 127517 - DNA, 32 bp, Homo sapiens; identical to SEQ ID NO: 97382
  chr7:28988955-28988987
  Hypo

SEQ ID NO: 127518 - DNA, 151 bp, Homo sapiens; identical to SEQ ID NO: 97383
  chr7:28989227-28989378
  Hypo

SEQ ID NO: 127519 - DNA, 425 bp, Homo sapiens; identical to SEQ ID NO: 97384
  chr7:28995567-28995992
  Hyper

SEQ ID NO: 127520 - DNA, 1885 bp, Homo sapiens
  chr7:28996324-28998209
  Hyper
gagacctgcaggtggcgtcatctcctcccctgcggccgtgggtaggggctgccgcctgcggtcagcggtcagggaagctgagggcgagggatccgcgcaggatccattttgcagctgctggtcatccaggtaatccaggtatttgcctcgcagggccggggggtggcgacactgcacgaagacagtgaggagccggccctgcgagtgccagtcgcccatccagcgcttcaggcctcgcagccggcagtcgcaggtccagccgttgccgtctagatccagccgataaagggctgggctggcggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcccctgagcgagagcaggccgagacgtggcaggtgctggaagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgagcacgtcgtgggggctcggccagcgagctggtcttgggcactacgcggagccccctgttggtgcacaggagatgctggggatgctggcagtcgcagcgctccgggcacacgggctcggcagcggcgggagcgcgaggcagccgcacaccacgagcaggaggcgcaaggcgcgggcagcctccatcgcctcccgccctgcgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcggctccagtgcaatagctcggggagcacgcgggctgcgtccggaagggacccaag

SEQ ID NO: 127521 - DNA, 382 bp, Homo sapiens; identical to SEQ ID NO: 31189
  chr7:29185815-29186197
  Hyper

SEQ ID NO: 127522 - DNA, 382 bp, Homo sapiens; identical to SEQ ID NO: 97392
  chr7:29234504-29234886
  Hyper

SEQ ID NO: 127523 - DNA, 105 bp, Homo sapiens; identical to SEQ ID NO: 97396
  chr7:29482437-29482542
  Hypo

SEQ ID NO: 127524 - DNA, 1463 bp, Homo sapiens; identical to SEQ ID NO: 97401
  chr7:29603263-29604726
  Hyper

SEQ ID NO: 127525 - DNA, 97 bp, Homo sapiens; identical to SEQ ID NO: 97406
  chr7:29679947-29680044
  Hypo

SEQ ID NO: 127526 - DNA, 124 bp, Homo sapiens; identical to SEQ ID NO: 97410
  chr7:29845873-29845997
  Hyper

SEQ ID NO: 127527 - DNA, 547 bp, Homo sapiens; identical to SEQ ID NO: 97411
  chr7:29846202-29846749
  Hyper

SEQ ID NO: 127528 - DNA, 38 bp, Homo sapiens; identical to SEQ ID NO: 41244
  chr7:29876677-29876715
  Hypo

SEQ ID NO: 127529 - DNA, 218 bp, Homo sapiens; identical to SEQ ID NO: 97413
  chr7:29883063-29883281
  Hypo

SEQ ID NO: 127530 - DNA, 30 bp, Homo sapiens; identical to SEQ ID NO: 97414
  chr7:29884235-29884265
  Hypo

SEQ ID NO: 127531 - DNA, 30 bp, Homo sapiens; identical to SEQ ID NO: 97415
  chr7:29966074-29966104
  Hypo

SEQ ID NO: 127532 - DNA, 30 bp, Homo sapiens; identical to SEQ ID NO: 97416
  chr7:29977605-29977635
  Hypo

SEQ ID NO: 127533 - DNA, 369 bp, Homo sapiens; identical to SEQ ID NO: 97417
  chr7:30028510-30028879
  Hyper

SEQ ID NO: 127534 - DNA, 54 bp, Homo sapiens; identical to SEQ ID NO: 97418
  chr7:30029248-30029302
  Hyper

SEQ ID NO: 127535 - DNA, 38 bp, Homo sapiens; identical to SEQ ID NO: 97419
  chr7:30180528-30180566
  Hypo

SEQ ID NO: 127536 - DNA, 153 bp, Homo sapiens; identical to SEQ ID NO: 97420
  chr7:30206381-30206534
  Hypo

SEQ ID NO: 127537 - DNA, 38 bp, Homo sapiens; identical to SEQ ID NO: 97423
  chr7:30340811-30340849
  Hypo

SEQ ID NO: 127538 - DNA, 41 bp, Homo sapiens; identical to SEQ ID NO: 97426
  chr7:30565248-30565289
  Hypo

SEQ ID NO: 127539 - DNA, 45 bp, Homo sapiens; identical to SEQ ID NO: 97427
  chr7:30603391-30603436
  Hypo

SEQ ID NO: 127540 - DNA, 190 bp, Homo sapiens; identical to SEQ ID NO: 97428
  chr7:30687808-30687998
  Hypo

SEQ ID NO: 127541 - DNA, 30 bp, Homo sapiens; identical to SEQ ID NO: 41248
  chr7:30699730-30699760
  Hypo

SEQ ID NO: 127542 - DNA, 1256 bp, Homo sapiens
  chr7:30721202-30722458
  Hyper
gggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcagtagggctcagaggggcccgcagggacgcggggctctcggagcgcggggtcaggggcgcacccagcgcgcgagagaaggagcccgcgcagcctccgaccgctcgcctcccgcctaccctcggggtccaggggtggcccccagccgtccaagagcagctcttcagccagcgccaggctgcagttggcctccagcaggctgtggagcagtgccgcgtccatcgcgtcccgcagccgcgtgcggagagggagtgggagtgcgcgcccggcgtgactgcgagggagtggacgcgagagtgagcggccgagagggcgcggggtcctggcccccgccagcccagccccgatctcccgggcagcctttgggcgccacctccggtcgcccagagctgtcaagtggggaccttcccggagaggagccgccgagtgcacggagctgcgggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcctgagcttcccc

SEQ ID NO: 127543 - DNA, 165 bp, Homo sapiens; identical to SEQ ID NO: 97435
  chr7:30744677-30744842
  Hypo

SEQ ID NO: 127544 - DNA, 58 bp, Homo sapiens; identical to SEQ ID NO: 97436
  chr7:30780708-30780766
  Hypo

SEQ ID NO: 127545 - DNA, 179 bp, Homo sapiens; identical to SEQ ID NO: 97441
  chr7:30899905-30900084
  Hypo

SEQ ID NO: 127546 - DNA, 30 bp, Homo sapiens; identical to SEQ ID NO: 97442
  chr7:31018956-31018986
  Hypo

SEQ ID NO: 127547 - DNA, 1295 bp, Homo sapiens
  chr7:31091895-31093190
  Hyper
gtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtggacggacgcacctacgcggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtcttcgtttcccgtggcgcggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcgggaccttggcaggttagggggctcagaagggacaggggagccgatggatgcaactagaccctcaggagggaacccagccggaagccgattgcatttcacgtggagctgaggag

SEQ ID NO: 127548 - DNA, 84 bp, Homo sapiens; identical to SEQ ID NO: 41251
  chr7:31116600-31116684
  Hypo

SEQ ID NO: 127549 - DNA, 248 bp, Homo sapiens; identical to SEQ ID NO: 97448
  chr7:31118287-31118535
  Hypo

SEQ ID NO: 127550 - DNA, 40 bp, Homo sapiens; identical to SEQ ID NO: 97449
  chr7:31232678-31232718
  Hyper

SEQ ID NO: 127551 - DNA, 221 bp, Homo sapiens; identical to SEQ ID NO: 97451
  chr7:31375997-31376218
  Hyper

SEQ ID NO: 127552 - DNA, 158 bp, Homo sapiens; identical to SEQ ID NO: 97452
  chr7:31518808-31518966
  Hypo

SEQ ID NO: 127553 - DNA, 159 bp, Homo sapiens; identical to SEQ ID NO: 97453
  chr7:31528357-31528516
  Hyper

SEQ ID NO: 127554 - DNA, 34 bp, Homo sapiens; identical to SEQ ID NO: 97454
  chr7:31939253-31939287
  Hypo

SEQ ID NO: 127555 - DNA, 1017 bp, Homo sapiens
  chr7:32110065-32111082
  Hyper
tctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgggctggtgtctgggctgtcaccgcgggcgcggagggaggggcgcgcgggcaccgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcggaggttgggcctggaggtcccccacagcctcactctcgcacccgccacagaaccggatccattttgaaatattgaagcgactgatggggacgaagggaaccacacaccacactcaaaaactcttgatgttttcttgctaaaggggctctctcgctcgcgctctctctcctcc

SEQ ID NO: 127556 - DNA, 158 bp, Homo sapiens; identical to SEQ ID NO: 41253
  chr7:32128181-32128339
  Hypo

SEQ ID NO: 127557 - DNA, 16 bp, Homo sapiens
  chr7:32276939-32276955
  Hypo
ccgcccatctcggcta

SEQ ID NO: 127558 - DNA, 30 bp, Homo sapiens; identical to SEQ ID NO: 41255
  chr7:32323599-32323629
  Hypo

SEQ ID NO: 127559 - DNA, 1331 bp, Homo sapiens
  chr7:32337766-32339097
  Hyper
gtctgtcttgacgtccgcctctatctctggggcctaggtgtttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaatcgcagccaggaaaccgagcagttcggggaggtgtgatgctgaaaaccagcttccgcgcgacgccgggtcggagcccgcgaggggtgccgggggggacagcccagggtgcggcttctgtcccgacccagtcgccgctcccgggggctcccgcccggagagcaccctccggccccagcccgacccctgagctccccctgcccgcttagaaaggaactctgaccgccaccggagagggcgtttgcccgagccaggagtccgagaggggtggaaagttctcacctatggtgaagctgtagccatcgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgcctggccacgctactctctgtcagccgcggatcccgcgcgccacaggaaagtctgttttctacttcaccttctccttccgtctctggtggctggggggatttggggacccaagggaatggctgaattggcgtcgtgcgtcttctagatatgttttctctggcagaccggggagcttccagaaagcacatcaacagatggaaaggcaaacccctcagccatgagatgttgccgaagtttactccaaacaaggaagtcgggaaaatcgccacgcccacttccttctagccactgcccccagcactggcctggagccccgatagtgtttcttctccactgtccctgccaggaaggtaattgtcaaagtcaccggaggctctatgatgtgaaatgtacaatcgaattagaactcgc

SEQ ID NO: 127560 - DNA, 903 bp, Homo sapiens
  chr7:32467159-32468062
  Hyper
ttctccccatggtgccggccccggtactaagctggggaaagggatccttagggtgtaaactgtcttgccacctactgtttaaacctctgtgaaagataagccttctgaaatagcctcctattcaacccagaaatcaatcctaacttgtaaaagaagttatggacacgaggacgagaaacgggaaatcctgcgggagatagcgctttctcttttcccccagaaagtctccaggcagcagctctgtgagatccttaagcaaggtaaggaaactcacccgctgcgctgcggcttcgtggccagcagggctgggacatactcgcctcacgcttcagcaccggggacagctcctgcctcgccaacttcggcagctcttctcgatgtctcgccgcgggctgtgcctcacaggctacgggaggggagagtgtctccccacgccggggtcccggcctctgggttttagggagcgcgaatgggtctccgacagcaacgggagcagccggtggcgcctcaggctgcggtggcaacgagcccgactgcactacggctttgcgggaccgcgccagcgcggaggagaccgagcccatctcagcgggccgggccggacccaggtgagcggccctggctccccgaggaatccacggccctcgcctgccgaaggcttactccctcctggtgccggggcgcccccagctgtctgctccgcctctgaccctgcgggctgcagcgaaggctgcgcgcccacccgcgggggaccggaacggagggtaatgcgggcggtgtccgcgcccgcctaacagtctggggtggatgggacttggggagtcgctatatagaggctgtccggaggctttactggaaattgaggggaggaaggggcgtggcattaggcgagggatacttttt

SEQ ID NO: 127561 - DNA, 30 bp, Homo sapiens; identical to SEQ ID NO: 8997
  chr7:32468472-32468502
  Hyper

SEQ ID NO: 127562 - DNA, 89 bp, Homo sapiens; identical to SEQ ID NO: 97470
  chr7:32801573-32801662
  Hyper

SEQ ID NO: 127563 - DNA, 158 bp, Homo sapiens; identical to SEQ ID NO: 97477
  chr7:32982112-32982270
  Hyper

SEQ ID NO: 127564 - DNA, 438 bp, Homo sapiens; identical to SEQ ID NO: 97478
  chr7:32996944-32997382
  Hyper

SEQ ID NO: 127565 - DNA, 77 bp, Homo sapiens; identical to SEQ ID NO: 97484
  chr7:33545157-33545234
  Hypo

SEQ ID NO: 127566 - DNA, 2103 bp, Homo sapiens; identical to SEQ ID NO: 97485
  chr7:33943451-33945554
  Hyper

SEQ ID NO: 127567 - DNA, 30 bp, Homo sapiens; identical to SEQ ID NO: 97486
  chr7:33963977-33964007
  Hypo

SEQ ID NO: 127568 - DNA, 25 bp, Homo sapiens
  chr7:35190140-35190165
  Hypo
atcttttttttgagacggggtcttg

SEQ ID NO: 127569 - DNA, 1455 bp, Homo sapiens
  chr7:35225273-35226728
  Hyper
aagactcaagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgttcgaagccattcgcgcgggcagtccctgcgtgtccccctgcgtgtccccccacgtgctccccagcgcgcgcagcaccccgcctctgcgcttccccgagcgtgcagcttccggtgagggcagccccacgcacagcccccaacaccctccccagcgcctgcagccttcggtgcgcgcagtccccaagcccacatgcgcagttctcaccttgcgcgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcccggcattaggaaagtctctacgatcgctgaggtatcgggcagtcagtgcccgttgccaacgcggagggaacgggcggagactgcgggcaacacgtggcagagccggcgtgagtccggtgggtctgatcccagagcctcaggttgacgccacttccttggcacggaacagcgtttactgaatcttagagcaaaatgcttttccaatgaggttcctcagaagtcatcggccctaggagcggtgtgctcaagcgctttcagcaccag

SEQ ID NO: 127570 - DNA, 1800 bp, Homo sapiens
  chr7:35292877-35294677
  Hyper
gacaacttaggagaccgacgggcccagatataagatgcacattcacagcattcaacagactgaagcctccaaagaaaacttggacccaaaagaaaaagatctcccacccgcgatgtatggctcatggcttgagcatcagacgttgctgcgagccgcctgcagccaggggcacagacggatgcgcagcatccccagtcctcggcggacagccgggtagcccaacttacccaggggtttgattgtgttctccgtcgcctccttctccttagagccgccgctcgacatgagcgcggcaatggagaaggcgttggcccgagaggagagttggggcttgggggacgccgtgaactccatggtccccagcacgcggtcctggccagggacggggtcgtccgaactgccgtccagattccccaagggagacaaagacccgaaacacagctcaaagtttccgagagcagtcacagcggggccagggactccagaagtgtcagctccaacgactccagagctgcacactggcctctattccccaccgcaaagccccagagccgcagagacttcgaaggcagccggagaggagagggcccaccgagcactacggcgggtgcgcacgccccggggcgctcggcaggacgacagtctgcacagcccgaaggcggaaacgagcatcaactgcacaaagtcctggggtcctggagcatcccctccgcgtccttcctccctctggggctggggacagccgggatgtcccaggctgaggtggccaccagccgagcgcggctgctaggacgctggcgtggggagcgcggcgcggaactacggacagtgagccctggcgctcgctgccctgcgccttaatttgctggcggcggcgatcccggaggcccgcagccagtcagcgccgtctcacgtcaccgcttcctgattccgccgccgggggcggggccgcgggccgggcgcggagggcgcgcccagggtgcggcgcccgcgtggcctgtcgccccggctgttcggtaccccagcacaggttcagggaaaagggtgccaccactaggctgacgcagcagccatggacatccccacctggtctcacagccccgggcgggagggcggtgcgcgctgtcgggagaggacacatcaccgcggcctaacgcccgagatccgggcatggcccagttggggaagctatgaccagaccagtggaagcctcgggagttctcgctttttccattctttttcttacctgcgctcaaagttccaaaagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtgcgaaccttatggtagcgcccggactaagcggacacagacccctctggttttacaaaggcggctgtgacgaggacttcccacggccttgttggagggcgtcctgttagccctgctcagcctgaataactcaaattctccgaattcgcagggtaatccgcttcgcttggagccgtgt

SEQ ID NO: 127571 - DNA, 30 bp, Homo sapiens
  chr7:35295077-35295107
  Hyper
gctggaaggaatttacgctgtcttctagcc

SEQ ID NO: 127572 - DNA, 32 bp, Homo sapiens; identical to SEQ ID NO: 97498
  chr7:35295864-35295896
  Hyper

SEQ ID NO: 127573 - DNA, 1433 bp, Homo sapiens
  chr7:35296739-35298172
  Hyper
ccgtttaaactttggcgcctaagaatgtaaaattttgttatacatctgagtttgtttatatggaatttgattatatggaagactggaagatgtctccttatatacaccactctttcaaattctcatttgtagctcccggaactcagaagacagtcgacccccaaaactgtccaggaagtaatcggtttccggcttttggacaatggtccctcgcttaacgaatgctaacgaatgctcccttagctgggagctgcagggaccggtcccggcaggtctaaccaaccgtccgcaggcgccgtggtcgagagcagagccgagacggcggggcagggtgccaagcggagggcacagcctggcagccaccgttggcggcaggagagaatgggagaagggagacccgcttctcagcacaagggcatctgtctactcccgaacatggccggagattcctgtccacagcctccctccagctctttctggtagacactttaaaagcgacattaacgggcttcggtgcctttggattcctaaattaggtttacggaaaaggaaagacttcccaagaacagtgagaagaggaactgcagcccctccaaggccgctgcggcgcgttcccggggcgcgccgagagcagcgcgcggctccgtgccccgtggggagcgcgcggcgcggccttggatttcaccgcgagtcgggagggcgggtctgagccttgcctcccaggatccttccgacgaacaccccgcgggttttagtttatcgagccaaagtggtcccggagaagcgctccctcgcagccaagctgcaagaagtggccgggaacctacaggcctcgggccgacccaggaagcctccgcaccagaaagctcgaggagcccttacccaagtcttgctcgaagggcaaagcaaagagccagcacccctgagtgtcactgaagttcctggatggggtgtgagtgcgcgcgttccgtccgagacctcagtctcgcccagctatagagccgataaagggatgtcttgtgggcgtaaggcgcttcgcgcccatctccaaggccgatgtggtcaggaggtgaggggaaatgtccttctggcagaagcccgcggtgctgcgacgttgacccgcctggcctcaggctcagggcggcgggcagcccagggcacatgtagtttcagcagccgcgctacgtgggcgggggaccccaggccaccccacgtgtccgccctgggcctcctccgggtcccaaggcgcggcgcctccaggccttgtagcgtcttccccgggtccccgcgcgccaggccccgcagcctgctcacaggacagccctcggggctgcgaccctctcgctcctccccgcggccactcgctccccgttcatcccccacgagctcactaccgcagggaccggccctcagagccccgggcctcctcccgg

SEQ ID NO: 127574 - DNA, 1188 bp, Homo sapiens
  chr7:35300778-35301966
  Hyper
ggtctttctgccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtgctttcacttggcctgcgctcaggtcagtgcgccccttaccggagcacccatggcctcccgcgttaccccaaattttgtaggcagactgtcagagttcgaagccagctgtgtcctctgcgggccgtgtgaccctaggctatctgggctgctcggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattatcagacagggcttgcaggatggcgccggccgagctttacccccattagcacagggcaggctgggggctgggtcctgaggccaccgccggtcccggccagctgcagcttttctggggagctatgagaaaggcaggcctggtggctccggccttctctacccggccactctcaggctgacgagttattagaatt

SEQ ID NO: 127575 - DNA, 25 bp, Homo sapiens
  chr7:35327606-35327631
  Hypo
catgagccaccgagcctggccagaa

SEQ ID NO: 127576 - DNA, 87 bp, Homo sapiens; identical to SEQ ID NO: 97506
  chr7:35350106-35350193
  Hypo

SEQ ID NO: 127577 - DNA, 146 bp, Homo sapiens
  chr7:35494329-35494475
  Hyper
gcgccggccaatcagcgtatggctcagtcccgcgggccccgcttccaggtggagctgctcctgctctcggggtagccagggtcccgggcctggccgcggccccgcgggctcttacgctttcgcccccatctcgctccgcacgccag

SEQ ID NO: 127578 - DNA, 185 bp, Homo sapiens; identical to SEQ ID NO: 97510
  chr7:35579059-35579244
  Hypo

SEQ ID NO: 127579 - DNA, 30 bp, Homo sapiens; identical to SEQ ID NO: 97511
  chr7:35689006-35689036
  Hypo

SEQ ID NO: 127580 - DNA, 138 bp, Homo sapiens; identical to SEQ ID NO: 97512
  chr7:35839940-35840078
  Hyper

SEQ ID NO: 127581 - DNA, 88 bp, Homo sapiens; identical to SEQ ID NO: 41257
  chr7:36428640-36428728
  Hypo

SEQ ID NO: 127582 - DNA, 30 bp, Homo sapiens; identical to SEQ ID NO: 97514
  chr7:36441223-36441253
  Hypo

SEQ ID NO: 127583 - DNA, 30 bp, Homo sapiens; identical to SEQ ID NO: 97515
  chr7:36923939-36923969
  Hypo

SEQ ID NO: 127584 - DNA, 98 bp, Homo sapiens
  chr7:37025520-37025618
  Hypo
tactcaccaagctcccgtaagtccatctttcccaaccacaaatactgattctaagctgctgccaccacaaagcgacttagagtcgtccccctgaagaa

SEQ ID NO: 127585 - DNA, 60 bp, Homo sapiens; identical to SEQ ID NO: 97518
  chr7:37136264-37136324
  Hypo

SEQ ID NO: 127586 - DNA, 39 bp, Homo sapiens; identical to SEQ ID NO: 97519
  chr7:37211371-37211410
  Hypo

SEQ ID NO: 127587 - DNA, 30 bp, Homo sapiens; identical to SEQ ID NO: 14984
  chr7:37264509-37264539
  Hypo

SEQ ID NO: 127588 - DNA, 181 bp, Homo sapiens; identical to SEQ ID NO: 14985
  chr7:37279183-37279364
  Hypo

SEQ ID NO: 127589 - DNA, 30 bp, Homo sapiens; identical to SEQ ID NO: 97523
  chr7:37347397-37347427
  Hypo

SEQ ID NO: 127590 - DNA, 119 bp, Homo sapiens; identical to SEQ ID NO: 41261
  chr7:37399153-37399272
  Hypo

SEQ ID NO: 127591 - DNA, 24 bp, Homo sapiens
  chr7:37423707-37423731
  Hypo
gtgcccggccgaaacatacaggtt

SEQ ID NO: 127592 - DNA, 208 bp, Homo sapiens; identical to SEQ ID NO: 97526
  chr7:37424312-37424520
  Hypo

SEQ ID NO: 127593 - DNA, 43 bp, Homo sapiens; identical to SEQ ID NO: 97527
  chr7:37446822-37446865
  Hypo

SEQ ID NO: 127594 - DNA, 30 bp, Homo sapiens; identical to SEQ ID NO: 97528
  chr7:37484434-37484464
  Hypo

SEQ ID NO: 127595 - DNA, 138 bp, Homo sapiens; identical to SEQ ID NO: 97529
  chr7:37487113-37487251
  Hyper

SEQ ID NO: 127596 - DNA, 1817 bp, Homo sapiens
  chr7:37487371-37489188
  Hyper
cggcacagcaccgacttcccaaccccaaacacacgcgcgcacccccgggacagctgagttctgtatttcctcttcctcaaagcgactccggcgatcgcagtcgccactctccgctccgattcccgggccccctggcatgccgccgcccccttctctgaaggcgcgcccggtgcgtcccctctccgaagccgagatttccacgaagctccacaaagctccccgccgcctctctcggtctcggcggagaccccggtgtgtccccgggaggagagtatttactaaccagaacctcaggggctcccggctgcccagaccgccctctccggccctcctggcccccattcctctggcccatcaccgccccctcccacgagcgcgctcgccgggggattccctcccatccccgagtgcaggagaagacgccgagtctgagccgcagccgcttctctagctctataggaatcttgactccaagatcccagccccacatcccccgtccccagtaaccccgcgccagcgtcgcaaccctcccgcgccccccctcccgcagaccctggtcgaaatgtctcggcgggctcccgggccccgggccctgcgcttcatccgcgggcgccgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacccttggacagagtggcaaaaaaaaaaaaaaaaagtttcctccctctccgtcgacatctatgtatttactaaccctgcaattgaaactacaagatgtatttctaaccaattaagccagggacttcctaattttgcataactttgcataaggcaagacgttccacccataat

SEQ ID NO: 127597 - DNA, 30 bp, Homo sapiens; identical to SEQ ID NO: 97533
  chr7:37533583-37533613
  Hypo

SEQ ID NO: 127598 - DNA, 30 bp, Homo sapiens; identical to SEQ ID NO: 41265
  chr7:37686948-37686978
  Hypo

SEQ ID NO: 127599 - DNA, 142 bp, Homo sapiens; identical to SEQ ID NO: 97536
  chr7:37727598-37727740
  Hypo

SEQ ID NO: 127600 - DNA, 146 bp, Homo sapiens; identical to SEQ ID NO: 97537
  chr7:37770953-37771099
  Hypo

SEQ ID NO: 127601 - DNA, 178 bp, Homo sapiens; identical to SEQ ID NO: 97538
  chr7:37835728-37835906
  Hypo

SEQ ID NO: 127602 - DNA, 187 bp, Homo sapiens; identical to SEQ ID NO: 97539
  chr7:37868787-37868974
  Hypo

SEQ ID NO: 127603 - DNA, 30 bp, Homo sapiens; identical to SEQ ID NO: 97540
  chr7:37888029-37888059
  Hypo

SEQ ID NO: 127604 - DNA, 30 bp, Homo sapiens; identical to SEQ ID NO: 41268
  chr7:37907440-37907470
  Hypo

SEQ ID NO: 127605 - DNA, 30 bp, Homo sapiens; identical to SEQ ID NO: 97542
  chr7:37953791-37953821
  Hypo

SEQ ID NO: 127606 - DNA, 419 bp, Homo sapiens; identical to SEQ ID NO: 97543
  chr7:37955637-37956056
  Hyper

SEQ ID NO: 127607 - DNA, 308 bp, Homo sapiens; identical to SEQ ID NO: 31238
  chr7:37956260-37956568
  Hyper

SEQ ID NO: 127608 - DNA, 794 bp, Homo sapiens
  chr7:37960164-37960958
  Hyper
ccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagaggtacaggtcatcggcccgcggggcgggagtagggagccgcgcgggcatggggagggcgaggtcgcagaggcctgcgccctgtaactctttccggccccttgcagctcctcccttctcccagagagatctttcgcgaggagggtctctt

SEQ ID NO: 127609 - DNA, 41 bp, Homo sapiens; identical to SEQ ID NO: 97547
  chr7:37961158-37961199
  Hyper

SEQ ID NO: 127610 - DNA, 30 bp, Homo sapiens; identical to SEQ ID NO: 97548
  chr7:37962835-37962865
  Hypo

SEQ ID NO: 127611 - DNA, 30 bp, Homo sapiens; identical to SEQ ID NO: 41269
  chr7:37969938-37969968
  Hypo

SEQ ID NO: 127612 - DNA, 38 bp, Homo sapiens; identical to SEQ ID NO: 97550
  chr7:37973881-37973919
  Hypo

SEQ ID NO: 127613 - DNA, 30 bp, Homo sapiens; identical to SEQ ID NO: 97551
  chr7:38044515-38044545
  Hypo

SEQ ID NO: 127614 - DNA, 37 bp, Homo sapiens; identical to SEQ ID NO: 41270
  chr7:38170685-38170722
  Hypo

SEQ ID NO: 127615 - DNA, 30 bp, Homo sapiens; identical to SEQ ID NO: 97555
  chr7:38422917-38422947
  Hypo

SEQ ID NO: 127616 - DNA, 97 bp, Homo sapiens; identical to SEQ ID NO: 97556
  chr7:38508402-38508499
  Hypo

SEQ ID NO: 127617 - DNA, 868 bp, Homo sapiens
  chr7:38670306-38671174
  Hyper
agcactgtgtgatcacgatcctaccctattggtcctgggagatttttggtggcttctctgttaaatcgttcgtgtctgctgcacttaagtagccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccccggcgctgcgtcctcccgacccgctccccgcggcgcccgggtcgcgccttgcggcagtcaccgagctgagggcagggcgtcccagcgtccctggccccggccccgctccgcagcgcgccgcaccccgaggctcgggccccgcacagctgcagccggtgccctccggccaagcccccgcctggcgtccccggccccagccccggccgcccgccgctgaccttttcctgcgcgcggttgagtcgcttctggacgttcttggcgaagatgcccgtcttgatgtcggccatggctgcgggtccggggagctgcgaagagcagagcgcgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcgggactggctgtga

SEQ ID NO: 127618 - DNA, 79 bp, Homo sapiens; identical to SEQ ID NO: 97560
  chr7:38731677-38731756
  Hypo

SEQ ID NO: 127619 - DNA, 195 bp, Homo sapiens; identical to SEQ ID NO: 97561
  chr7:38740329-38740524
  Hypo

SEQ ID NO: 127620 - DNA, 30 bp, Homo sapiens; identical to SEQ ID NO: 97562
  chr7:38752794-38752824
  Hypo

SEQ ID NO: 127621 - DNA, 536 bp, Homo sapiens; identical to SEQ ID NO: 97565
  chr7:39015528-39016064
  Hyper

SEQ ID NO: 127622 - DNA, 30 bp, Homo sapiens; identical to SEQ ID NO: 97566
  chr7:39056562-39056592
  Hypo

SEQ ID NO: 127623 - DNA, 30 bp, Homo sapiens; identical to SEQ ID NO: 41273
  chr7:39192698-39192728
  Hypo

SEQ ID NO: 127624 - DNA, 199 bp, Homo sapiens; identical to SEQ ID NO: 97568
  chr7:39317796-39317995
  Hypo

SEQ ID NO: 127625 - DNA, 763 bp, Homo sapiens; identical to SEQ ID NO: 97570
  chr7:39453541-39454304
  Hyper

SEQ ID NO: 127626 - DNA, 57 bp, Homo sapiens; identical to SEQ ID NO: 97571
  chr7:39873278-39873335
  Hyper

SEQ ID NO: 127627 - DNA, 101 bp, Homo sapiens; identical to SEQ ID NO: 41275
  chr7:39921805-39921906
  Hypo

SEQ ID NO: 127628 - DNA, 93 bp, Homo sapiens; identical to SEQ ID NO: 97577
  chr7:40157085-40157178
  Hypo

SEQ ID NO: 127629 - DNA, 37 bp, Homo sapiens; identical to SEQ ID NO: 97578
  chr7:40401724-40401761
  Hypo

SEQ ID NO: 127630 - DNA, 142 bp, Homo sapiens; identical to SEQ ID NO: 97579
  chr7:40407687-40407829
  Hypo

SEQ ID NO: 127631 - DNA, 159 bp, Homo sapiens; identical to SEQ ID NO: 97581
  chr7:40603511-40603670
  Hypo

SEQ ID NO: 127632 - DNA, 30 bp, Homo sapiens; identical to SEQ ID NO: 97584
  chr7:40938913-40938943
  Hypo

SEQ ID NO: 127633 - DNA, 46 bp, Homo sapiens; identical to SEQ ID NO: 97585
  chr7:40943566-40943612
  Hypo

SEQ ID NO: 127634 - DNA, 30 bp, Homo sapiens; identical to SEQ ID NO: 97589
  chr7:41189426-41189456
  Hyper

SEQ ID NO: 127635 - DNA, 193 bp, Homo sapiens; identical to SEQ ID NO: 97594
  chr7:41699313-41699506
  Hypo

SEQ ID NO: 127636 - DNA, 89 bp, Homo sapiens; identical to SEQ ID NO: 97595
  chr7:41745163-41745252
  Hyper

SEQ ID NO: 127637 - DNA, 96 bp, Homo sapiens; identical to SEQ ID NO: 97596
  chr7:41814070-41814166
  Hypo

SEQ ID NO: 127638 - DNA, 30 bp, Homo sapiens; identical to SEQ ID NO: 97598
  chr7:41840845-41840875
  Hypo

SEQ ID NO: 127639 - DNA, 43 bp, Homo sapiens; identical to SEQ ID NO: 97599
  chr7:41850638-41850681
  Hypo

SEQ ID NO: 127640 - DNA, 30 bp, Homo sapiens; identical to SEQ ID NO: 41280
  chr7:41923780-41923810
  Hypo

SEQ ID NO: 127641 - DNA, 30 bp, Homo sapiens; identical to SEQ ID NO: 41281
  chr7:41943672-41943702
  Hypo

SEQ ID NO: 127642 - DNA, 17 bp, Homo sapiens
  chr7:41981795-41981812
  Hypo
gggcgtggtggctcacg

SEQ ID NO: 127643 - DNA, 159 bp, Homo sapiens; identical to SEQ ID NO: 97605
  chr7:42005369-42005528
  Hypo

SEQ ID NO: 127644 - DNA, 214 bp, Homo sapiens
  chr7:42267608-42267822
  Hyper
aagggatgtttttcacgcctttcaccacttttgcccgcgcctgcgtcccctgcccgaggtcccaggccgcggcggcggcgcggtgggttcattagcgggcgcgccgggcccgcgcagcgctgtctgcagccgcgtcgccgcatccatcatcattacatcagcgcggggaagtccacgccgagttctcccggccccggcgcgccccagtcagcgc

SEQ ID NO: 127645 - DNA, 1287 bp, Homo sapiens; identical to SEQ ID NO: 97612
  chr7:42275617-42276904
  Hyper

SEQ ID NO: 127646 - DNA, 276 bp, Homo sapiens; identical to SEQ ID NO: 97613
  chr7:42277312-42277588
  Hyper

SEQ ID NO: 127647 - DNA, 215 bp, Homo sapiens; identical to SEQ ID NO: 97614
  chr7:42277648-42277863
  Hyper

SEQ ID NO: 127648 - DNA, 390 bp, Homo sapiens
  chr7:42533038-42533428
  Hyper
gacagcaggagcagccggattttggaaagggaggaggccgggacgcatgcagcttggtgggggctgtgtccgaggtccgcagggagaagctgagcgacagccccagcagggacctactgctggcgcccactccccgcggccgctggccaagtgtgggctctcgggttcgtttccacccagcgcggcggtgttattcggagaaggaaaataaatgtctgcggttgctctgccgggctgcgggggcggtgccctggaaggaggggctgtgcatctgcaccatttctaggaatgtccgccctctgggaacccagccctgaagtgctctgagaatgagccgtgtttacggaaagcctctgtctcatgctccgcattctccgttctgattctgac

SEQ ID NO: 127649 - DNA, 26 bp, Homo sapiens
  chr7:42909823-42909849
  Hypo
actgggagtaatggccgggcgcggtg

SEQ ID NO: 127650 - DNA, 385 bp, Homo sapiens; identical to SEQ ID NO: 97623
  chr7:42927790-42928175
  Hyper

SEQ ID NO: 127651 - DNA, 1614 bp, Homo sapiens
  chr7:43151970-43153584
  Hyper
cacacacaaaagggccgaggagccagggttggtgttggatatgcccagtacgcgtgctgggtgttggaaggatggggccggcggtaacaagaatcgatatatatttaccgcgggggcgggggtgggggtgcgcggaggctgcagggcggggcagcgctaatgagagcaagcccggcttgtggttggttctggagtctggtacccacagaggagcaggcagggagggaggggatgcaagcgggaggataaagcgatgaagtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcccagcccacacccaccccttgtgaaccaaagctctggatttgcgcttcgccttgggctcgcttttgaacaattgtgtcccatgcaatgcccgtggttagcccagagagcgcccagagcctccgcacgggctcgccggtgctcgctcgaggggcgcgtggccaggtccggcccttgctcccatggacgggtgcaggaggggaggaggcgctgtgtgggtgctcccccagcgcctccctgttaccggccggctgcgccgctcagccgggcctgccacctgagttttagcgggagcagtcatgtcgcctaccgtattgcgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggtt

SEQ ID NO: 127652 - DNA, 177 bp, Homo sapiens; identical to SEQ ID NO: 41284
  chr7:43237814-43237991
  Hypo

SEQ ID NO: 127653 - DNA, 285 bp, Homo sapiens; identical to SEQ ID NO: 97632
  chr7:43279396-43279681
  Hypo

SEQ ID NO: 127654 - DNA, 30 bp, Homo sapiens; identical to SEQ ID NO: 97633
  chr7:43282402-43282432
  Hypo

SEQ ID NO: 127655 - DNA, 30 bp, Homo sapiens; identical to SEQ ID NO: 97634
  chr7:43304457-43304487
  Hypo

SEQ ID NO: 127656 - DNA, 69 bp, Homo sapiens; identical to SEQ ID NO: 97635
  chr7:43351483-43351552
  Hypo

SEQ ID NO: 127657 - DNA, 30 bp, Homo sapiens; identical to SEQ ID NO: 97638
  chr7:43656702-43656732
  Hypo

SEQ ID NO: 127658 - DNA, 153 bp, Homo sapiens; identical to SEQ ID NO: 97639
  chr7:43767840-43767993
  Hypo

SEQ ID NO: 127659 - DNA, 202 bp, Homo sapiens; identical to SEQ ID NO: 41286
  chr7:43865061-43865263
  Hypo

SEQ ID NO: 127660 - DNA, 25 bp, Homo sapiens
  chr7:44083435-44083460
  Hypo
ccaccgtgcccggcaggatttatat

SEQ ID NO: 127661 - DNA, 43 bp, Homo sapiens; identical to SEQ ID NO: 97642
  chr7:44097753-44097796
  Hypo

SEQ ID NO: 127662 - DNA, 633 bp, Homo sapiens
  chr7:44143891-44144524
  Hyper
ccgggggtggggagccggctccggaagccccggcgcccccgccccgggccccgccagcgctttggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaaggtaagag

SEQ ID NO: 127663 - DNA, 41 bp, Homo sapiens; identical to SEQ ID NO: 97645
  chr7:44149886-44149927
  Hypo

SEQ ID NO: 127664 - DNA, 71 bp, Homo sapiens; identical to SEQ ID NO: 97646
  chr7:44151000-44151071
  Hypo

SEQ ID NO: 127665 - DNA, 501 bp, Homo sapiens; identical to SEQ ID NO: 97647
  chr7:44151276-44151777
  Hypo

SEQ ID NO: 127666 - DNA, 96 bp, Homo sapiens; identical to SEQ ID NO: 97648
  chr7:44152156-44152252
  Hypo

SEQ ID NO: 127667 - DNA, 194 bp, Homo sapiens; identical to SEQ ID NO: 97649
  chr7:44153428-44153622
  Hypo

SEQ ID NO: 127668 - DNA, 35 bp, Homo sapiens; identical to SEQ ID NO: 97650
  chr7:44164101-44164136
  Hypo

SEQ ID NO: 127669 - DNA, 30 bp, Homo sapiens; identical to SEQ ID NO: 41290
  chr7:44193301-44193331
  Hypo

SEQ ID NO: 127670 - DNA, 189 bp, Homo sapiens; identical to SEQ ID NO: 97652
  chr7:44258465-44258654
  Hypo

SEQ ID NO: 127671 - DNA, 53 bp, Homo sapiens; identical to SEQ ID NO: 41292
  chr7:44259286-44259339
  Hypo

SEQ ID NO: 127672 - DNA, 30 bp, Homo sapiens; identical to SEQ ID NO: 41293
  chr7:44275594-44275624
  Hypo

SEQ ID NO: 127673 - DNA, 30 bp, Homo sapiens; identical to SEQ ID NO: 97655
  chr7:44279543-44279573
  Hypo

SEQ ID NO: 127674 - DNA, 30 bp, Homo sapiens; identical to SEQ ID NO: 97656
  chr7:44298773-44298803
  Hypo

SEQ ID NO: 127675 - DNA, 205 bp, Homo sapiens; identical to SEQ ID NO: 97657
  chr7:44304621-44304826
  Hypo

SEQ ID NO: 127676 - DNA, 30 bp, Homo sapiens; identical to SEQ ID NO: 97658
  chr7:44307247-44307277
  Hypo

SEQ ID NO: 127677 - DNA, 47 bp, Homo sapiens; identical to SEQ ID NO: 97659
  chr7:44307677-44307724
  Hypo

SEQ ID NO: 127678 - DNA, 170 bp, Homo sapiens
  chr7:44349559-44349729
  Hyper
ctcgcgaaggacacgcgggaagagcctttccgccggctgagccgtgggcgccaccgccagggaccccaggctcaccaagccacgcgcggaaccgcacggtggccgagaccgggcgggggcgggggcgctttgggagttaggatacgctttgtgcccgcttgctgcttttt

SEQ ID NO: 127679 - DNA, 773 bp, Homo sapiens
  chr7:44364485-44365258
  Hyper
tcccgccacccccgccgcctgccgctcgggtgggggtggggacagcgcacccgcgtcggggacgaccctctggggccgcagccgacccctcccggcgctccaggcccgggggccacccccgcgcgcccctcctctctgacctccccgccgccaaatgcgtcacgtctgccgggcgctccggggacacctgctgccgcccccgccgcgccaagtcgcgagcccggagccccggcccggcagccgcgctgggcagagctgggcagggccgcgcgcgctgaggtcaggcagccaggcccggggccgggggctcgcgggtcggggccgcgcggggccgtgcgcttgggcccggagcccagagaagccggcggcgcgcgggcccgcagtgcgcctggagccggcggcgcggagggtcccggaggtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcccgctcgcgggcacggcggcgacacgggcgcgggcgcgggagacacctcggctcgcggcgccaggcgggggccgggctgggctgcgccgggcggcgagcgcacgcgagatctgctcgctccgtcctcgccaggagcgcgccgcacacctacgcgcggggaggcgcgggcgccgctgt

SEQ ID NO: 127680 - DNA, 40 bp, Homo sapiens; identical to SEQ ID NO: 97665
  chr7:44430994-44431034
  Hypo

SEQ ID NO: 127681 - DNA, 37 bp, Homo sapiens; identical to SEQ ID NO: 97666
  chr7:44517855-44517892
  Hypo

SEQ ID NO: 127682 - DNA, 59 bp, Homo sapiens; identical to SEQ ID NO: 97667
  chr7:44582470-44582529
  Hypo

SEQ ID NO: 127683 - DNA, 30 bp, Homo sapiens; identical to SEQ ID NO: 41296
  chr7:44717883-44717913
  Hypo

SEQ ID NO: 127684 - DNA, 30 bp, Homo sapiens; identical to SEQ ID NO: 97670
  chr7:44746915-44746945
  Hypo

SEQ ID NO: 127685 - DNA, 30 bp, Homo sapiens; identical to SEQ ID NO: 97671
  chr7:44796802-44796832
  Hypo

SEQ ID NO: 127686 - DNA, 30 bp, Homo sapiens; identical to SEQ ID NO: 41297
  chr7:44801185-44801215
  Hypo

SEQ ID NO: 127687 - DNA, 277 bp, Homo sapiens; identical to SEQ ID NO: 97674
  chr7:44835107-44835384
  Hypo

SEQ ID NO: 127688 - DNA, 42 bp, Homo sapiens; identical to SEQ ID NO: 97675
  chr7:44896731-44896773
  Hyper

SEQ ID NO: 127689 - DNA, 216 bp, Homo sapiens; identical to SEQ ID NO: 97676
  chr7:44924253-44924469
  Hyper

SEQ ID NO: 127690 - DNA, 40 bp, Homo sapiens; identical to SEQ ID NO: 97677
  chr7:44967575-44967615
  Hypo

SEQ ID NO: 127691 - DNA, 30 bp, Homo sapiens; identical to SEQ ID NO: 97678
  chr7:45005732-45005762
  Hypo

SEQ ID NO: 127692 - DNA, 27 bp, Homo sapiens
  chr7:45027184-45027211
  Hypo
attgttaagggacgaaagggccaagag

SEQ ID NO: 127693 - DNA, 34 bp, Homo sapiens; identical to SEQ ID NO: 97680
  chr7:45038532-45038566
  Hypo

SEQ ID NO: 127694 - DNA, 34 bp, Homo sapiens; identical to SEQ ID NO: 41301
  chr7:45125675-45125709
  Hypo

SEQ ID NO: 127695 - DNA, 680 bp, Homo sapiens; identical to SEQ ID NO: 97683
  chr7:45128453-45129133
  Hyper

SEQ ID NO: 127696 - DNA, 37 bp, Homo sapiens; identical to SEQ ID NO: 97684
  chr7:45197017-45197054
  Hyper

SEQ ID NO: 127697 - DNA, 214 bp, Homo sapiens; identical to SEQ ID NO: 97685
  chr7:45197376-45197590
  Hyper

SEQ ID NO: 127698 - DNA, 108 bp, Homo sapiens; identical to SEQ ID NO: 97686
  chr7:45222863-45222971
  Hypo

SEQ ID NO: 127699 - DNA, 45 bp, Homo sapiens; identical to SEQ ID NO: 97687
  chr7:45293665-45293710
  Hypo

SEQ ID NO: 127700 - DNA, 1537 bp, Homo sapiens
  chr7:45613422-45614959
  Hyper
cgcccacagggtctccgcgaccctagagcttagggaagaattgccgaggggcggggggtccctcatgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccggcgggcgggaacgcaggacgcggagttggggcgcgggctgtgcgcgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacggtaagtgcagccgcgcacccctcatctggtctcggacacacttgctgggacgatgctgggaatgcccggagtcgggcgcgctttttcctatgcggcgggtggggacactgaggctccgagtgggggtgtgttcaaggtcactcctacgagttggggacgcagtcggggctggcaccct

SEQ ID NO: 127701 - DNA, 30 bp, Homo sapiens; identical to SEQ ID NO: 97691
  chr7:45615610-45615640
  Hyper

SEQ ID NO: 127702 - DNA, 30 bp, Homo sapiens; identical to SEQ ID NO: 97692
  chr7:45717349-45717379
  Hypo

SEQ ID NO: 127703 - DNA, 30 bp, Homo sapiens; identical to SEQ ID NO: 97693
  chr7:45807201-45807231
  Hypo

SEQ ID NO: 127704 - DNA, 30 bp, Homo sapiens; identical to SEQ ID NO: 97694
  chr7:45807471-45807501
  Hypo

SEQ ID NO: 127705 - DNA, 33 bp, Homo sapiens; identical to SEQ ID NO: 97695
  chr7:45928114-45928147
  Hyper

SEQ ID NO: 127706 - DNA, 243 bp, Homo sapiens; identical to SEQ ID NO: 97696
  chr7:45928349-45928592
  Hyper

SEQ ID NO: 127707 - DNA, 1583 bp, Homo sapiens; identical to SEQ ID NO: 97697
  chr7:45959968-45961551
  Hyper

SEQ ID NO: 127708 - DNA, 218 bp, Homo sapiens; identical to SEQ ID NO: 97698
  chr7:45961756-45961974
  Hyper

SEQ ID NO: 127709 - DNA, 241 bp, Homo sapiens; identical to SEQ ID NO: 97702
  chr7:47394691-47394932
  Hypo

SEQ ID NO: 127710 - DNA, 45 bp, Homo sapiens; identical to SEQ ID NO: 97703
  chr7:47409164-47409209
  Hypo

SEQ ID NO: 127711 - DNA, 203 bp, Homo sapiens; identical to SEQ ID NO: 41306
  chr7:47420119-47420322
  Hypo

SEQ ID NO: 127712 - DNA, 142 bp, Homo sapiens; identical to SEQ ID NO: 41307
  chr7:47420382-47420524
  Hypo

SEQ ID NO: 127713 - DNA, 30 bp, Homo sapiens; identical to SEQ ID NO: 97706
  chr7:47446763-47446793
  Hypo

SEQ ID NO: 127714 - DNA, 30 bp, Homo sapiens; identical to SEQ ID NO: 41308
  chr7:47449194-47449224
  Hypo

SEQ ID NO: 127715 - DNA, 121 bp, Homo sapiens; identical to SEQ ID NO: 97708
  chr7:47513123-47513244
  Hypo

SEQ ID NO: 127716 - DNA, 30 bp, Homo sapiens; identical to SEQ ID NO: 97710
  chr7:47515683-47515713
  Hypo

SEQ ID NO: 127717 - DNA, 61 bp, Homo sapiens; identical to SEQ ID NO: 41309
  chr7:47586473-47586534
  Hypo

SEQ ID NO: 127718 - DNA, 30 bp, Homo sapiens; identical to SEQ ID NO: 41310
  chr7:47702782-47702812
  Hypo

SEQ ID NO: 127719 - DNA, 1012 bp, Homo sapiens; identical to SEQ ID NO: 97721
  chr7:48074892-48075904
  Hyper

SEQ ID NO: 127720 - DNA, 18 bp, Homo sapiens
  chr7:48465341-48465359
  Hypo
atttatttattttttcga

SEQ ID NO: 127721 - DNA, 20 bp, Homo sapiens
  chr7:49493501-49493521
  Hypo
cagcccgccatgcctgagcc

SEQ ID NO: 127722 - DNA, 203 bp, Homo sapiens; identical to SEQ ID NO: 97749
  chr7:49700763-49700966
  Hypo

SEQ ID NO: 127723 - DNA, 179 bp, Homo sapiens; identical to SEQ ID NO: 97750
  chr7:49740612-49740791
  Hypo

SEQ ID NO: 127724 - DNA, 3074 bp, Homo sapiens
  chr7:49812691-49815765
  Hyper
agaggaagatgggagcggggagagattggcagagattcagaaagttcgcgcttgagatttttacgtttcttactcgtaaacgtctatttctctgggtttctgaatgcaaagacgagaaagtctcaacagtctgctaaactaacacggccttcgaatcccaatctgaacacagtagctgaaacaagctgtccacaaagaggaaagccagagggggccaattaggaaggaagaaattaaagaaaagagaaaagccaagatgaaaggtccagcgcaaagtgaatgactcgactggagaatggcagccctggcagggtctgcggccggctgcggaggtggggacgcggccgcgcggacgagtgacaggttggtccggcgcagcaaagggagcgggtgcggcggtagggcctctccgggggcagcgcgagggcctcccccggggcagcgcgggccaaggcggggcctccagagcgggggcagcagaggagggagcggaacgggagccgggcggaggcggctgcggcagggggaggcgggaggcgggcgcgctagctcccatgctggcctcggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatgtatgtaggtttggcgccggtcttcagggctgagggtgcatgctgggtgtccccgcgcggccggacgcgctccagctgggttcagccgctcagctgctccggaggaaccccctcccccgcccaagtttgtgaatatgggcgcttcgcccagtgttgaggtcggcagggaccgggcagggggtcagcagggccgggcacgtccggagccctcagggaggagggctgagggggaggggacagacgcaccggagtgcgcagagtgggggcgttcggggagtgaggcggagagaggctggattgccggtgtcctgcggcgtctcgggctctcccagcccctttgggcggcagaaactttggaatccagaaaggctggccgggatccagcgagtaggagggtctcgcgcccactctgcgccctggggccccagcctcccgcactgcacaccttggtgctgcccgggcgcttctgctccgcagccaggacactacaagactgagcgctgcggccggcgacctggctcccaaggctcggaggggcgggccggcagaggagctgaagccccgggaatccccgacccggccctctggcaaggggccgagggcatcctttcatgcagcggggcttagagagcggggagggggcgtctgctcccgagacgggagtcttttaagaagttgttagaaatgaatcgtggagtcctaggagaagctttgtttaacctccccgcattttcccagcacaaccccctaaagcaaatgaggaagagtttccctcttatcttcctgtacattcgtccgtctctaactccactgctgaattctccatttaataaccttcgggaaatgtggccaggacctagggagggacaccctgggtgcctgaattacgtggttcaaggcagagctttgcaggggggcgcgggcctggctcgctgcgttccctgggctccgcaagccgcccttggccatctccaacactaatcacgactacatcagaaacacgccggccggtgtcgttcttggatttcgcttccaatgtatcgctccacagtttgtgatgtctaagaaccccggccgtgcaccgacgctgggcatgctgcccccgcccccgtcgcccagctcgttaatctagagctatgccggagcccgggtgggggccgcggcgggccggggcgcgcgcgggccgcggggctcagttgtgctgctgttctctccgcagggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgcctctcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtaagatgcgaacgcccgccgggcgactttgcaccttc

SEQ ID NO: 127725 - DNA, 30 bp, Homo sapiens; identical to SEQ ID NO: 97760
  chr7:50140443-50140473
  Hypo

SEQ ID NO: 127726 - DNA, 20 bp, Homo sapiens
  chr7:50141622-50141642
  Hypo
aatgccaaaatttgccgggc

SEQ ID NO: 127727 - DNA, 37 bp, Homo sapiens; identical to SEQ ID NO: 97762
  chr7:50207925-50207962
  Hypo

SEQ ID NO: 127728 - DNA, 80 bp, Homo sapiens; identical to SEQ ID NO: 97764
  chr7:50231283-50231363
  Hypo

SEQ ID NO: 127729 - DNA, 30 bp, Homo sapiens; identical to SEQ ID NO: 41313
  chr7:50241354-50241384
  Hypo

SEQ ID NO: 127730 - DNA, 206 bp, Homo sapiens; identical to SEQ ID NO: 97766
  chr7:50243557-50243763
  Hypo

SEQ ID NO: 127731 - DNA, 255 bp, Homo sapiens; identical to SEQ ID NO: 97767
  chr7:50251373-50251628
  Hypo

SEQ ID NO: 127732 - DNA, 262 bp, Homo sapiens; identical to SEQ ID NO: 97769
  chr7:50293897-50294159
  Hypo

SEQ ID NO: 127733 - DNA, 22 bp, Homo sapiens
  chr7:50294459-50294481
  Hypo
catgaatcggtattcaattgta

SEQ ID NO: 127734 - DNA, 30 bp, Homo sapiens; identical to SEQ ID NO: 41317
  chr7:50337681-50337711
  Hypo

SEQ ID NO: 127735 - DNA, 30 bp, Homo sapiens; identical to SEQ ID NO: 97772
  chr7:50342284-50342314
  Hypo

SEQ ID NO: 127736 - DNA, 1530 bp, Homo sapiens
  chr7:50343208-50344738
  Hyper
cctcgggtgggcactcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttacgcgcgggtcccgcagcgccgcggccgagccgggctgcccggcccgcggacacagcgccggccgccgcatcccgtgcggggccgcggcgcgatgctgcgctggaatgaggaagcgcggcggcgaggggagggcccgggcgcggtgcgcgcgggggtggcggcggcgcgccgagcgggcccggcgcgggcgagcgggctgcagccggcggcggcgccagcaggtacggcccgcacccgccgccgccccggcggcctttgggggctgagccggagcccggcgcgattgcaaagttttcgtgcgcggcccctctggcccggagttgcggctgagacgcgcgccgcgcgagccgggggactcggcgacggggcggggacgggacgacgcaccctctccgtgtcccgctctgcgcccttctgcgcgccccgctccctgtaccggagcagcgatccgggaggcggccgagaggtgcgcgcggggccgagccggctgcggggcaggtcgagcagggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggagaaatggggaacaatgcgagtgagcaacttcaggaagtcattgtgaaagaaagctgggaagagctccgcggccaagttagcaggacactctaacaagtgactgcgcggcccgcgcccggggcggtgactgcggcaagccccctgggtccccgcgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacactt

SEQ ID NO: 127737 - DNA, 42 bp, Homo sapiens; identical to SEQ ID NO: 97777
  chr7:50365027-50365069
  Hypo

SEQ ID NO: 127738 - DNA, 34 bp, Homo sapiens; identical to SEQ ID NO: 97779
  chr7:50423090-50423124
  Hypo

SEQ ID NO: 127739 - DNA, 166 bp, Homo sapiens; identical to SEQ ID NO: 41320
  chr7:50438618-50438784
  Hypo

SEQ ID NO: 127740 - DNA, 156 bp, Homo sapiens; identical to SEQ ID NO: 97781
  chr7:50444259-50444415
  Hypo

SEQ ID NO: 127741 - DNA, 30 bp, Homo sapiens; identical to SEQ ID NO: 97782
  chr7:50454697-50454727
  Hypo

SEQ ID NO: 127742 - DNA, 30 bp, Homo sapiens; identical to SEQ ID NO: 41322
  chr7:50471189-50471219
  Hypo

SEQ ID NO: 127743 - DNA, 106 bp, Homo sapiens; identical to SEQ ID NO: 41323
  chr7:50560557-50560663
  Hypo

SEQ ID NO: 127744 - DNA, 30 bp, Homo sapiens; identical to SEQ ID NO: 97785
  chr7:50561907-50561937
  Hypo

SEQ ID NO: 127745 - DNA, 99 bp, Homo sapiens; identical to SEQ ID NO: 97787
  chr7:50860193-50860292
  Hyper

SEQ ID NO: 127746 - DNA, 45 bp, Homo sapiens
  chr7:50861076-50861121
  Hyper
aactttgggctccaccgggtctccgagcgccgagcccgcccggcc

SEQ ID NO: 127747 - DNA, 196 bp, Homo sapiens; identical to SEQ ID NO: 97789
  chr7:50861335-50861531
  Hyper

SEQ ID NO: 127748 - DNA, 62 bp, Homo sapiens; identical to SEQ ID NO: 97791
  chr7:51383330-51383392
  Hyper

SEQ ID NO: 127749 - DNA, 669 bp, Homo sapiens; identical to SEQ ID NO: 97792
  chr7:51384251-51384920
  Hyper

SEQ ID NO: 127750 - DNA, 105 bp, Homo sapiens; identical to SEQ ID NO: 97793
  chr7:51408343-51408448
  Hypo

SEQ ID NO: 127751 - DNA, 30 bp, Homo sapiens; identical to SEQ ID NO: 97795
  chr7:51873296-51873326
  Hypo

SEQ ID NO: 127752 - DNA, 69 bp, Homo sapiens; identical to SEQ ID NO: 97796
  chr7:51886447-51886516
  Hypo

SEQ ID NO: 127753 - DNA, 28 bp, Homo sapiens
  chr7:52268621-52268649
  Hypo
ttttgtttgtttgttcgtttgtttgttt

SEQ ID NO: 127754 - DNA, 30 bp, Homo sapiens; identical to SEQ ID NO: 41325
  chr7:52499272-52499302
  Hypo

SEQ ID NO: 127755 - DNA, 61 bp, Homo sapiens; identical to SEQ ID NO: 97800
  chr7:52736850-52736911
  Hypo

SEQ ID NO: 127756 - DNA, 30 bp, Homo sapiens; identical to SEQ ID NO: 97802
  chr7:53103556-53103586
  Hypo

SEQ ID NO: 127757 - DNA, 60 bp, Homo sapiens; identical to SEQ ID NO: 97803
  chr7:53104173-53104233
  Hypo

SEQ ID NO: 127758 - DNA, 105 bp, Homo sapiens; identical to SEQ ID NO: 97810
  chr7:53364374-53364479
  Hypo

SEQ ID NO: 127759 - DNA, 755 bp, Homo sapiens
  chr7:54609581-54610336
  Hyper
aaattcgtgtgaaatcgtagcatgtgatgctcctggttggagcagttaataactgggtaagcggcatttccctaaatggctgttttcctcggcccacccgtctctcccccatcccattgctccccggtcctcagcaatgccccaactccctcccggaaccttttgctccgagccccccgccagcgccgcaatcccgtcactgtattgtcctcctcggcaccgagcgatctgatccgccgagccagaaagacacccgatgggggagagaagcaaagtggaaaaaaaccgacgtccctgctctccagaagggagaccccagcggcgccgacgagccctgcgccctccgcggccgcccggcgcgagctcccgggcggggcgctgtccagcgcgcacagagttaaaggcatcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctga

SEQ ID NO: 127760 - DNA, 489 bp, Homo sapiens; identical to SEQ ID NO: 97820
  chr7:54612317-54612806
  Hyper

SEQ ID NO: 127761 - DNA, 148 bp, Homo sapiens; identical to SEQ ID NO: 97821
  chr7:54614009-54614157
  Hyper

SEQ ID NO: 127762 - DNA, 153 bp, Homo sapiens; identical to SEQ ID NO: 97822
  chr7:54614380-54614533
  Hyper

SEQ ID NO: 127763 - DNA, 38 bp, Homo sapiens; identical to SEQ ID NO: 97823
  chr7:54614739-54614777
  Hyper

SEQ ID NO: 127764 - DNA, 510 bp, Homo sapiens; identical to SEQ ID NO: 31295
  chr7:54732044-54732554
  Hyper

SEQ ID NO: 127765 - DNA, 253 bp, Homo sapiens; identical to SEQ ID NO: 97828
  chr7:54794703-54794956
  Hypo

SEQ ID NO: 127766 - DNA, 19 bp, Homo sapiens
  chr7:54846014-54846033
  Hypo
tgccatggctgggcacggt

SEQ ID NO: 127767 - DNA, 30 bp, Homo sapiens; identical to SEQ ID NO: 41329
  chr7:54866907-54866937
  Hypo

SEQ ID NO: 127768 - DNA, 118 bp, Homo sapiens; identical to SEQ ID NO: 97833
  chr7:55086571-55086689
  Hyper

SEQ ID NO: 127769 - DNA, 820 bp, Homo sapiens; identical to SEQ ID NO: 97834
  chr7:55086983-55087803
  Hyper

SEQ ID NO: 127770 - DNA, 135 bp, Homo sapiens; identical to SEQ ID NO: 97835
  chr7:55145845-55145980
  Hypo

SEQ ID NO: 127771 - DNA, 194 bp, Homo sapiens; identical to SEQ ID NO: 97842
  chr7:55382606-55382800
  Hypo

SEQ ID NO: 127772 - DNA, 305 bp, Homo sapiens; identical to SEQ ID NO: 97843
  chr7:55410019-55410324
  Hypo

SEQ ID NO: 127773 - DNA, 30 bp, Homo sapiens; identical to SEQ ID NO: 97844
  chr7:55432093-55432123
  Hypo

SEQ ID NO: 127774 - DNA, 30 bp, Homo sapiens; identical to SEQ ID NO: 97845
  chr7:55570199-55570229
  Hypo

SEQ ID NO: 127775 - DNA, 157 bp, Homo sapiens; identical to SEQ ID NO: 97848
  chr7:55838624-55838781
  Hypo

SEQ ID NO: 127776 - DNA, 19 bp, Homo sapiens
  chr7:55940140-55940159
  Hypo
tttatttttttgagacgga

SEQ ID NO: 127777 - DNA, 360 bp, Homo sapiens; identical to SEQ ID NO: 97851
  chr7:56017869-56018229
  Hypo

SEQ ID NO: 127778 - DNA, 240 bp, Homo sapiens; identical to SEQ ID NO: 97853
  chr7:56018469-56018709
  Hypo

SEQ ID NO: 127779 - DNA, 23 bp, Homo sapiens
  chr7:56031846-56031869
  Hypo
tgttaaagcgttgtggggctttt

SEQ ID NO: 127780 - DNA, 25 bp, Homo sapiens
  chr7:56120758-56120783
  Hypo
ttaccaggcccgtgcccagctgggt

SEQ ID NO: 127781 - DNA, 30 bp, Homo sapiens; identical to SEQ ID NO: 41334
  chr7:56144506-56144536
  Hypo

SEQ ID NO: 127782 - DNA, 17 bp, Homo sapiens
  chr7:56172896-56172913
  Hypo
cccggccactttaatct

SEQ ID NO: 127783 - DNA, 35 bp, Homo sapiens; identical to SEQ ID NO: 97861
  chr7:56176289-56176324
  Hypo

SEQ ID NO: 127784 - DNA, 597 bp, Homo sapiens
  chr7:56183581-56184178
  Hyper
tgcggttccctaatacggttccctcagaggcagccgactctgcccagggcgagcagcgccgcgccgtggggggacgctcctagggtccccggggcactggttgggggaggtgttgggcgcacgtacccaggctcaggtgaggcgagtgcgcatcttgggatgcagctggcgctggcggcgcttgcgctggccattgaggagcttctgcgcgaccttgcgctcgtgcccgccaggtgcaggccagttggtgcgcagcgcctgctcgcgccgagtccggcccttgctgcgccctgccccgcaggccgggaagtcgcgcaggtagtagtagtccaggcagtcgtaaagctcctcctcgtagcttatgggtggcggcggccgagccagagcctgcagacgtggaagcgcccgctctgcgggcgcttccatcctgcccaggcctgtggccaccggcggccacctgcccgcgtctgggcgctcctggaagacccagcagccccgcctcgagttccgatgggctccgcgtgaaggtgggggtgccttcggcgacgccacagaggcggaccttcgacgacgtcacagtggcggtacagtgcctgg

SEQ ID NO: 127785 - DNA, 30 bp, Homo sapiens
  chr7:56243024-56243054
  Hyper
aggcggtggctgcaacgaggaggagctggg

SEQ ID NO: 127786 - DNA, 251 bp, Homo sapiens
  chr7:56355493-56355744
  Hyper
cccgcgcggcacagacgcggggagcgcgcttggcgctgacacagcggcgacggcggcggcgttagccggcgctcgagctgtttcccttcctggggcgccgaccccgcccgcttgcttgcttgcctgcctgcctgcctgcctggcgccatgcaagagaaggtgccaggggacgcggagcgacgagaggcgcgcggtcccggacagctccgtctctggcgttggcgctgcagccgtgacggaggactacggcg

SEQ ID NO: 127787 - DNA, 167 bp, Homo sapiens; identical to SEQ ID NO: 97875
  chr7:57247720-57247887
  Hypo

SEQ ID NO: 127788 - DNA, 45 bp, Homo sapiens; identical to SEQ ID NO: 97876
  chr7:57259548-57259593
  Hypo

SEQ ID NO: 127789 - DNA, 104 bp, Homo sapiens; identical to SEQ ID NO: 97877
  chr7:57259653-57259757
  Hypo

SEQ ID NO: 127790 - DNA, 21 bp, Homo sapiens
  chr7:57655640-57655661
  Hypo
ccaccgcgcctggcccatata

SEQ ID NO: 127791 - DNA, 30 bp, Homo sapiens; identical to SEQ ID NO: 97879
  chr7:57832360-57832390
  Hypo

SEQ ID NO: 127792 - DNA, 17 bp, Homo sapiens
  chr7:57928223-57928240
  Hyper
accgggggaaaaagccg

SEQ ID NO: 127793 - DNA, 30 bp, Homo sapiens; identical to SEQ ID NO: 97897
  chr7:63020296-63020326
  Hypo

SEQ ID NO: 127794 - DNA, 24 bp, Homo sapiens
  chr7:63393338-63393362
  Hypo
gtgcctggccggtttggaagaaat

SEQ ID NO: 127795 - DNA, 30 bp, Homo sapiens; identical to SEQ ID NO: 97899
  chr7:63562154-63562184
  Hypo

SEQ ID NO: 127796 - DNA, 46 bp, Homo sapiens; identical to SEQ ID NO: 97900
  chr7:63574716-63574762
  Hypo

SEQ ID NO: 127797 - DNA, 156 bp, Homo sapiens; identical to SEQ ID NO: 97901
  chr7:63652683-63652839
  Hypo

SEQ ID NO: 127798 - DNA, 180 bp, Homo sapiens; identical to SEQ ID NO: 97902
  chr7:63666583-63666763
  Hypo

SEQ ID NO: 127799 - DNA, 30 bp, Homo sapiens; identical to SEQ ID NO: 97903
  chr7:63709605-63709635
  Hypo

SEQ ID NO: 127800 - DNA, 30 bp, Homo sapiens; identical to SEQ ID NO: 97904
  chr7:63767097-63767127
  Hyper

SEQ ID NO: 127801 - DNA, 503 bp, Homo sapiens; identical to SEQ ID NO: 97905
  chr7:63767577-63768080
  Hyper

SEQ ID NO: 127802 - DNA, 30 bp, Homo sapiens; identical to SEQ ID NO: 97906
  chr7:63804386-63804416
  Hypo

SEQ ID NO: 127803 - DNA, 156 bp, Homo sapiens; identical to SEQ ID NO: 97907
  chr7:63813303-63813459
  Hypo

SEQ ID NO: 127804 - DNA, 40 bp, Homo sapiens; identical to SEQ ID NO: 97909
  chr7:63867671-63867711
  Hypo

SEQ ID NO: 127805 - DNA, 38 bp, Homo sapiens; identical to SEQ ID NO: 97910
  chr7:63931021-63931059
  Hypo

SEQ ID NO: 127806 - DNA, 107 bp, Homo sapiens
  chr7:64030014-64030121
  Hyper
gcaccttcaggccctcggccgtgccgctgctcagtagtctgtcatccttataccactggaaatccgcgggggaaaccgccatggcttcgcagcgcagtaggcggccc

SEQ ID NO: 127807 - DNA, 146 bp, Homo sapiens
  chr7:64030481-64030627
  Hyper
aggtgtagaggccctcgtcgccgagccccacctcggtgacgaggatggagaactcctcgggggtgttgatgagcagccgcacccgcgggtccctggtcctgcggtcgttgccggcgtacaggatgttggagcggttcagccaggcc

SEQ ID NO: 127808 - DNA, 139 bp, Homo sapiens; identical to SEQ ID NO: 97912
  chr7:64030846-64030985
  Hyper

SEQ ID NO: 127809 - DNA, 301 bp, Homo sapiens; identical to SEQ ID NO: 97914
  chr7:64330254-64330555
  Hypo

SEQ ID NO: 127810 - DNA, 153 bp, Homo sapiens; identical to SEQ ID NO: 97915
  chr7:64337977-64338130
  Hyper

SEQ ID NO: 127811 - DNA, 30 bp, Homo sapiens; identical to SEQ ID NO: 97916
  chr7:64340264-64340294
  Hypo

SEQ ID NO: 127812 - DNA, 50 bp, Homo sapiens; identical to SEQ ID NO: 97917
  chr7:64345161-64345211
  Hypo

SEQ ID NO: 127813 - DNA, 113 bp, Homo sapiens
  chr7:64349026-64349139
  Hyper
ccctgaccagggggccgcgtcttcggcaaagtcttcggggtgagaggtccggctcctggaggacagcgggatgggagagtcccgttcacacccagccccgcagagccggatag

SEQ ID NO: 127814 - DNA, 55 bp, Homo sapiens; identical to SEQ ID NO: 97919
  chr7:64349409-64349464
  Hyper

SEQ ID NO: 127815 - DNA, 36 bp, Homo sapiens; identical to SEQ ID NO: 97920
  chr7:64350000-64350036
  Hyper

SEQ ID NO: 127816 - DNA, 78 bp, Homo sapiens; identical to SEQ ID NO: 97921
  chr7:64362694-64362772
  Hypo

SEQ ID NO: 127817 - DNA, 492 bp, Homo sapiens
  chr7:64407742-64408234
  Hyper
cgctctcccacctagcggggacccccagccccgccagccgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgtgtgggggcggaggggacgcggtgggtgcggcctgggcgcgggtgggctagagcctggagaccgccgggagcccgacttcctggcgctttgccctttggggagcggagccaaggaacagcgccaacctctctccacaagccagggaccctacgacccaccgccgca

SEQ ID NO: 127818 - DNA, 17 bp, Homo sapiens
  chr7:64416654-64416671
  Hypo
gccgccagtgggctctt

SEQ ID NO: 127819 - DNA, 29 bp, Homo sapiens
  chr7:64450761-64450790
  Hypo
tggccactggcccagcggattaacatcca

SEQ ID NO: 127820 - DNA, 131 bp, Homo sapiens; identical to SEQ ID NO: 97930
  chr7:64458258-64458389
  Hypo

SEQ ID NO: 127821 - DNA, 79 bp, Homo sapiens; identical to SEQ ID NO: 97931
  chr7:64459087-64459166
  Hypo

SEQ ID NO: 127822 - DNA, 39 bp, Homo sapiens; identical to SEQ ID NO: 97932
  chr7:64540683-64540722
  Hypo

SEQ ID NO: 127823 - DNA, 428 bp, Homo sapiens; identical to SEQ ID NO: 97934
  chr7:64700283-64700711
  Hyper

SEQ ID NO: 127824 - DNA, 806 bp, Homo sapiens; identical to SEQ ID NO: 97935
  chr7:64712198-64713004
  Hyper

SEQ ID NO: 127825 - DNA, 642 bp, Homo sapiens; identical to SEQ ID NO: 97936
  chr7:64734196-64734838
  Hyper

SEQ ID NO: 127826 - DNA, 22 bp, Homo sapiens
  chr7:64824069-64824091
  Hypo
ccgcacccggcaataaacactt

SEQ ID NO: 127827 - DNA, 180 bp, Homo sapiens; identical to SEQ ID NO: 97938
  chr7:64974268-64974448
  Hyper

SEQ ID NO: 127828 - DNA, 480 bp, Homo sapiens; identical to SEQ ID NO: 97939
  chr7:64974508-64974988
  Hyper

SEQ ID NO: 127829 - DNA, 102 bp, Homo sapiens; identical to SEQ ID NO: 31309
  chr7:65037609-65037711
  Hyper

SEQ ID NO: 127830 - DNA, 23 bp, Homo sapiens
  chr7:65234809-65234832
  Hypo
attacaggcgtgagccaccatgc

SEQ ID NO: 127831 - DNA, 78 bp, Homo sapiens; identical to SEQ ID NO: 97944
  chr7:65236247-65236325
  Hypo

SEQ ID NO: 127832 - DNA, 30 bp, Homo sapiens; identical to SEQ ID NO: 97948
  chr7:65441788-65441818
  Hypo

SEQ ID NO: 127833 - DNA, 91 bp, Homo sapiens; identical to SEQ ID NO: 97949
  chr7:65446021-65446112
  Hyper

SEQ ID NO: 127834 - DNA, 139 bp, Homo sapiens; identical to SEQ ID NO: 97951
  chr7:65508904-65509043
  Hyper

SEQ ID NO: 127835 - DNA, 30 bp, Homo sapiens; identical to SEQ ID NO: 97952
  chr7:65509512-65509542
  Hyper

SEQ ID NO: 127836 - DNA, 43 bp, Homo sapiens; identical to SEQ ID NO: 97953
  chr7:65553975-65554018
  Hypo

SEQ ID NO: 127837 - DNA, 30 bp, Homo sapiens; identical to SEQ ID NO: 97954
  chr7:65554426-65554456
  Hypo

SEQ ID NO: 127838 - DNA, 62 bp, Homo sapiens; identical to SEQ ID NO: 97955
  chr7:65575903-65575965
  Hypo

SEQ ID NO: 127839 - DNA, 22 bp, Homo sapiens
  chr7:65877882-65877904
  Hypo
tccgtctcgggggggaaaaaaa

SEQ ID NO: 127840 - DNA, 22 bp, Homo sapiens
  chr7:65879595-65879617
  Hypo
gtaaagtaattgggccggcccc

SEQ ID NO: 127841 - DNA, 81 bp, Homo sapiens; identical to SEQ ID NO: 41342
  chr7:65880043-65880124
  Hypo

SEQ ID NO: 127842 - DNA, 77 bp, Homo sapiens; identical to SEQ ID NO: 97965
  chr7:65969578-65969655
  Hypo

SEQ ID NO: 127843 - DNA, 30 bp, Homo sapiens; identical to SEQ ID NO: 97966
  chr7:65973031-65973061
  Hypo

SEQ ID NO: 127844 - DNA, 17 bp, Homo sapiens
  chr7:66105665-66105682
  Hypo
gtagtccaggccactcg

SEQ ID NO: 127845 - DNA, 196 bp, Homo sapiens; identical to SEQ ID NO: 97968
  chr7:66105802-66105998
  Hypo

SEQ ID NO: 127846 - DNA, 30 bp, Homo sapiens; identical to SEQ ID NO: 97969
  chr7:66150814-66150844
  Hypo

SEQ ID NO: 127847 - DNA, 97 bp, Homo sapiens; identical to SEQ ID NO: 97970
  chr7:66215014-66215111
  Hypo

SEQ ID NO: 127848 - DNA, 30 bp, Homo sapiens; identical to SEQ ID NO: 97971
  chr7:66293248-66293278
  Hypo

SEQ ID NO: 127849 - DNA, 30 bp, Homo sapiens; identical to SEQ ID NO: 97975
  chr7:67033662-67033692
  Hypo

SEQ ID NO: 127850 - DNA, 40 bp, Homo sapiens; identical to SEQ ID NO: 41345
  chr7:67161739-67161779
  Hypo

SEQ ID NO: 127851 - DNA, 38 bp, Homo sapiens; identical to SEQ ID NO: 97981
  chr7:67478598-67478636
  Hypo

SEQ ID NO: 127852 - DNA, 17 bp, Homo sapiens
  chr7:67478991-67479008
  Hypo
gccggtatagggattgt

SEQ ID NO: 127853 - DNA, 30 bp, Homo sapiens; identical to SEQ ID NO: 97983
  chr7:67665226-67665256
  Hypo

SEQ ID NO: 127854 - DNA, 120 bp, Homo sapiens; identical to SEQ ID NO: 97984
  chr7:68000314-68000434
  Hypo

SEQ ID NO: 127855 - DNA, 30 bp, Homo sapiens; identical to SEQ ID NO: 97985
  chr7:68149438-68149468
  Hypo

SEQ ID NO: 127856 - DNA, 30 bp, Homo sapiens; identical to SEQ ID NO: 97986
  chr7:68150297-68150327
  Hypo

SEQ ID NO: 127857 - DNA, 159 bp, Homo sapiens; identical to SEQ ID NO: 97987
  chr7:68191278-68191437
  Hypo

SEQ ID NO: 127858 - DNA, 206 bp, Homo sapiens; identical to SEQ ID NO: 97988
  chr7:68204758-68204964
  Hypo

SEQ ID NO: 127859 - DNA, 20 bp, Homo sapiens
  chr7:68237178-68237198
  Hypo
gactccgtctcaaaaaaaaa

SEQ ID NO: 127860 - DNA, 185 bp, Homo sapiens; identical to SEQ ID NO: 97990
  chr7:68238305-68238490
  Hypo

SEQ ID NO: 127861 - DNA, 32 bp, Homo sapiens; identical to SEQ ID NO: 97991
  chr7:68358134-68358166
  Hypo

SEQ ID NO: 127862 - DNA, 33 bp, Homo sapiens; identical to SEQ ID NO: 97992
  chr7:68527746-68527779
  Hypo

SEQ ID NO: 127863 - DNA, 30 bp, Homo sapiens; identical to SEQ ID NO: 97993
  chr7:68904116-68904146
  Hypo

SEQ ID NO: 127864 - DNA, 27 bp, Homo sapiens
  chr7:68982718-68982745
  Hypo
tgtgagccaccgcgcctggccattgct

SEQ ID NO: 127865 - DNA, 30 bp, Homo sapiens; identical to SEQ ID NO: 97995
  chr7:69033875-69033905
  Hypo

SEQ ID NO: 127866 - DNA, 42 bp, Homo sapiens; identical to SEQ ID NO: 15004
  chr7:69036110-69036152
  Hypo

SEQ ID NO: 127867 - DNA, 140 bp, Homo sapiens; identical to SEQ ID NO: 97997
  chr7:69048212-69048352
  Hypo

SEQ ID NO: 127868 - DNA, 679 bp, Homo sapiens; identical to SEQ ID NO: 97998
  chr7:69062359-69063038
  Hyper

SEQ ID NO: 127869 - DNA, 93 bp, Homo sapiens; identical to SEQ ID NO: 97999
  chr7:69063459-69063552
  Hyper

SEQ ID NO: 127870 - DNA, 30 bp, Homo sapiens; identical to SEQ ID NO: 98000
  chr7:69063870-69063900
  Hyper

SEQ ID NO: 127871 - DNA, 979 bp, Homo sapiens
  chr7:69064182-69065161
  Hyper
tcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgt

SEQ ID NO: 127872 - DNA, 16 bp, Homo sapiens
  chr7:69092470-69092486
  Hypo
ccgtctcaaaaaaacc

SEQ ID NO: 127873 - DNA, 30 bp, Homo sapiens; identical to SEQ ID NO: 98004
  chr7:69206297-69206327
  Hypo

SEQ ID NO: 127874 - DNA, 30 bp, Homo sapiens; identical to SEQ ID NO: 98005
  chr7:69217444-69217474
  Hypo

SEQ ID NO: 127875 - DNA, 215 bp, Homo sapiens; identical to SEQ ID NO: 98006
  chr7:69313658-69313873
  Hypo

SEQ ID NO: 127876 - DNA, 86 bp, Homo sapiens; identical to SEQ ID NO: 98007
  chr7:69499763-69499849
  Hypo

SEQ ID NO: 127877 - DNA, 25 bp, Homo sapiens
  chr7:69499909-69499934
  Hypo
tgggcccaagcgatcctctcacctt

SEQ ID NO: 127878 - DNA, 30 bp, Homo sapiens; identical to SEQ ID NO: 98009
  chr7:69510019-69510049
  Hypo

SEQ ID NO: 127879 - DNA, 146 bp, Homo sapiens; identical to SEQ ID NO: 98011
  chr7:69696309-69696455
  Hypo

SEQ ID NO: 127880 - DNA, 30 bp, Homo sapiens; identical to SEQ ID NO: 41352
  chr7:69698849-69698879
  Hypo

SEQ ID NO: 127881 - DNA, 136 bp, Homo sapiens; identical to SEQ ID NO: 98013
  chr7:69745578-69745714
  Hypo

SEQ ID NO: 127882 - DNA, 227 bp, Homo sapiens; identical to SEQ ID NO: 98014
  chr7:69897720-69897947
  Hypo

SEQ ID NO: 127883 - DNA, 134 bp, Homo sapiens; identical to SEQ ID NO: 98015
  chr7:70061015-70061149
  Hyper

SEQ ID NO: 127884 - DNA, 30 bp, Homo sapiens; identical to SEQ ID NO: 98017
  chr7:70311103-70311133
  Hypo

SEQ ID NO: 127885 - DNA, 1122 bp, Homo sapiens
  chr7:70596147-70597269
  Hyper
atttgaacagagcagcgggtgggcctagaagcagtgactggggaggttagaattcttgcacgcagagaacccccccaagcccgctcacgcccggcctggctccgaaggtctcagaatccgagcctccaggccagattttccctctagccattcctggccacgcagcgcggagccgcgagcacacagaaaaggatgtcttcatcgccaaccgggatggaacgaacccgcccgctcagggagtactgagaactaaagggtccctccagcgccggccgcagccagcatgccttgactgcctccatcccgcgcggtccccactctccagaagcccccgccctgcccgggtgcgcgcgcgcacgagtcggcgaaccggggagctgtgcgctcggcagcctgcgggcggcggcggcggccgccgacagcctctcggggacagggtggcgaagagcggcggaggaggagctggcgccgccgccgctcccctcgggccgcgccccgccctccgccgccacctgcgcgtcccctccgggctcctcagctccggggctgtgtggctctcggtgccgcagcggcggtgtcaccgcgtccgccaattgggagactcggcgttttggctcccgggggcgcgggacgagccgcgcggccggatctggcgagcggagggtgattcggcacgcgtacctccccgccgcgctgcccgcgacgttttgggagggggtagagaactgctgtgacttttgaggtccgactccttccggccagcctcgcgacgcgccagctccgagacaggccggtgtgccctgaaggccccgaaggctctcggcgcggtttgggggcttggaacgtgtccgggagccggcggcgctgtgagcgctggtgagtttgccggcggggtggggtggactccgcgcggggggcggagaggacgtagcgctcggcccggcgcccgccccctagtgctgcccccactttgagagtaattgagacttgagcgtgactgcggagcctggaggatgcgggctccccgagcgggcttcccctctgcccggcgcgatggagcgggtcggtgagcggaacaaaggcgcctgcccgggggagcgggtcttccgctgaagagcgcgg

SEQ ID NO: 127886 - DNA, 168 bp, Homo sapiens; identical to SEQ ID NO: 98020
  chr7:70597490-70597658
  Hyper

SEQ ID NO: 127887 - DNA, 632 bp, Homo sapiens
  chr7:70597883-70598515
  Hyper
ggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggtaaggacgcacgccggcgcctccggggctcgacgcgggcgggccgggcacagggtgagccccagggtccttgcgcgctgcgccctgtgcctgggagccggcacaccctggctcccgcgcgctccttcttacccttcctgccccgtttcgggcagatggccggggctgctggaaagaacaacttgcctgattcttttctgtgccccacctgcaaatttggttttatcctggaaacatgtcagtacagttggctcccggtccccgcgtgcggactggaaatcattccctggcgactccagcccgagcgcagaaactagtggaggggccacatgggactggaggcgcgcgggcagacgtgtaggaggaaatagtcttagagcccagcgtttggtggggtaccagtagggaacctgggagattggagggcttggatgtctgcagacaaagtcaaggccccaggtcgcggagctaatgcgcttaggtagtata

SEQ ID NO: 127888 - DNA, 30 bp, Homo sapiens; identical to SEQ ID NO: 98023
  chr7:70699941-70699971
  Hypo

SEQ ID NO: 127889 - DNA, 39 bp, Homo sapiens; identical to SEQ ID NO: 98024
  chr7:70728615-70728654
  Hypo

SEQ ID NO: 127890 - DNA, 30 bp, Homo sapiens; identical to SEQ ID NO: 98025
  chr7:70802549-70802579
  Hypo

SEQ ID NO: 127891 - DNA, 138 bp, Homo sapiens; identical to SEQ ID NO: 98026
  chr7:70840301-70840439
  Hypo

SEQ ID NO: 127892 - DNA, 39 bp, Homo sapiens; identical to SEQ ID NO: 98042
  chr7:71211002-71211041
  Hypo

SEQ ID NO: 127893 - DNA, 245 bp, Homo sapiens; identical to SEQ ID NO: 98043
  chr7:71217033-71217278
  Hyper

SEQ ID NO: 127894 - DNA, 30 bp, Homo sapiens; identical to SEQ ID NO: 98044
  chr7:71252818-71252848
  Hypo

SEQ ID NO: 127895 - DNA, 30 bp, Homo sapiens; identical to SEQ ID NO: 98045
  chr7:71265604-71265634
  Hypo

SEQ ID NO: 127896 - DNA, 150 bp, Homo sapiens; identical to SEQ ID NO: 98046
  chr7:71296028-71296178
  Hypo

SEQ ID NO: 127897 - DNA, 79 bp, Homo sapiens; identical to SEQ ID NO: 98047
  chr7:71299737-71299816
  Hypo

SEQ ID NO: 127898 - DNA, 30 bp, Homo sapiens; identical to SEQ ID NO: 98048
  chr7:71398187-71398217
  Hypo

SEQ ID NO: 127899 - DNA, 34 bp, Homo sapiens; identical to SEQ ID NO: 98049
  chr7:71416278-71416312
  Hypo

SEQ ID NO: 127900 - DNA, 216 bp, Homo sapiens; identical to SEQ ID NO: 98050
  chr7:71420713-71420929
  Hypo

SEQ ID NO: 127901 - DNA, 143 bp, Homo sapiens; identical to SEQ ID NO: 98051
  chr7:71472525-71472668
  Hypo

SEQ ID NO: 127902 - DNA, 41 bp, Homo sapiens; identical to SEQ ID NO: 98052
  chr7:71643690-71643731
  Hypo

SEQ ID NO: 127903 - DNA, 76 bp, Homo sapiens; identical to SEQ ID NO: 98053
  chr7:71669270-71669346
  Hypo

SEQ ID NO: 127904 - DNA, 198 bp, Homo sapiens; identical to SEQ ID NO: 98054
  chr7:71737907-71738105
  Hypo

SEQ ID NO: 127905 - DNA, 39 bp, Homo sapiens; identical to SEQ ID NO: 98055
  chr7:71775955-71775994
  Hypo

SEQ ID NO: 127906 - DNA, 1765 bp, Homo sapiens
  chr7:71800631-71802396
  Hyper
gggaactgcaggcaccgcttcacccaggagctacgggcttcgacccaaatggaagaaaggcgccttcctcacacaagcctcgtccaagaaaaaagagcagtgggaaacgatggtgggctggtggcccgggcgcacgtggcccaaggctaagacgcaagccgatcccctcggtgcacgctctgtacccccagcccgtctggatggggcgtcccccgctcgccctcgccccaagggtggcccagaactacctgctgctgcctaggcgccctcggaccaagtctcgggaagttcactccgcgctgcgctagtccggagaaactaggaacccgagtaaacccagactgtccggggaagacggatcccacccccacctgggcgccagacccatccagctgcttggagctcagagactaggtcccagccggactgcagaggcctctctggttaccccttgcaccctggcgcccccggactcggggtgggtggcggcgaggagcgtgcgcccagaaaggcaagcagtcagcgctaggggccggaggtggagagaaccctgcctcccgcctcccccgatcgccatgactccggcttcgcgaagagacctggttgccgccgggcgctcccacctgggctgcggtgcggctccgagtcccctgccctccctccccatcgcccgggcgcctgcgggcgggggcgcgcagcctggtggccactggcgcctgggggctagaagagcggctcccagcctccagcccgcacggtgccgggacagccgagtccgccgcggcccttccctagccccacgtccccaggcaggcggccaggagccagctccacggaaggcaaggtggccggcgcggcccccagcccgcggggtgggtgccccagtgtcggagccaacaggtacgggaggcgctgtctgccaaccatctgcccactctgagcaccagggcccgcgacagcccgggggtttggacaccctagagagaagcgaggaccgagggaagaagaaaagagagcgcgcgcgcgggtaagctagggagccggcggcggcactcacctcttgctgggccggggctccgcagcccggcagccgaggcgcctccgcacagcgcggggggcttcctccgaggcccgcagggagggggcggtgcggaatggatgcgccgagcgggcagcgctcagcctctcgctcacacccccagcaggcagccgcgtccccgtgccggcatcctcgctgccgccggctccctcggcgcccccgggccgctccccacgcgcgcgccgggacctgcacgagccccctcgtcgactcggagcgcgatctgggcgcgtgcctccctgtccttgtcctctgctctcgtctggggacgtgtgccccgcaccccctgcaccgcgcgctcctctacccctcccgctcccgctggccgcgcgggttcagcccatgtgcgcggctgcctcgctgcgccccggagcccagtggccgaggccccgctggagttgcgcgccctagaaactccatgcagctccggcctcctccccagctcctccccagcggatcccccagggccttgccgccgacagcaccacactcctcgctctgccggcgcccgcgttcaggagccgggcttctgggctcgccttggccgcctgcgccccagctcctccgagggtcggggagcccccaccccccaacctccgcctctccaatggctccctcggtttccaagcagcgcaacctgaggaacgcctcggcgcgcgcgcactc

SEQ ID NO: 127907 - DNA, 325 bp, Homo sapiens
  chr7:71802456-71802781
  Hyper
cacgcggggggcgagcaggcgcttggcagacggtgctccttccttcccttcccaaagaggctgcccacgttaactccggcaaactgctgctcctcagcacaggacaactcaccctagcgcccgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagcgatcccactcctcc

SEQ ID NO: 127908 - DNA, 30 bp, Homo sapiens; identical to SEQ ID NO: 98062
  chr7:71871052-71871082
  Hypo

SEQ ID NO: 127909 - DNA, 25 bp, Homo sapiens
  chr7:71877300-71877325
  Hypo
cggatagcaccccagcgagcttccc

SEQ ID NO: 127910 - DNA, 30 bp, Homo sapiens; identical to SEQ ID NO: 41356
  chr7:71880817-71880847
  Hypo

SEQ ID NO: 127911 - DNA, 183 bp, Homo sapiens; identical to SEQ ID NO: 98065
  chr7:71912763-71912946
  Hypo

SEQ ID NO: 127912 - DNA, 30 bp, Homo sapiens; identical to SEQ ID NO: 41357
  chr7:75975426-75975456
  Hypo

SEQ ID NO: 127913 - DNA, 30 bp, Homo sapiens; identical to SEQ ID NO: 98073
  chr7:76033259-76033289
  Hypo

SEQ ID NO: 127914 - DNA, 49 bp, Homo sapiens; identical to SEQ ID NO: 41358
  chr7:76106331-76106380
  Hypo

SEQ ID NO: 127915 - DNA, 185 bp, Homo sapiens; identical to SEQ ID NO: 98078
  chr7:76145361-76145546
  Hyper

SEQ ID NO: 127916 - DNA, 30 bp, Homo sapiens; identical to SEQ ID NO: 98079
  chr7:76604327-76604357
  Hypo

SEQ ID NO: 127917 - DNA, 93 bp, Homo sapiens; identical to SEQ ID NO: 98080
  chr7:76631511-76631604
  Hypo

SEQ ID NO: 127918 - DNA, 40 bp, Homo sapiens; identical to SEQ ID NO: 98081
  chr7:76751676-76751716
  Hyper

SEQ ID NO: 127919 - DNA, 20 bp, Homo sapiens
  chr7:77051320-77051340
  Hypo
accaccgtgcccagccaaca

SEQ ID NO: 127920 - DNA, 28 bp, Homo sapiens
  chr7:77309374-77309402
  Hypo
tggagtgcagtggtccgcctcccgggtt

SEQ ID NO: 127921 - DNA, 28 bp, Homo sapiens
  chr7:77309582-77309610
  Hypo
aggcgtgagccatcgtgcccggccagac

SEQ ID NO: 127922 - DNA, 93 bp, Homo sapiens; identical to SEQ ID NO: 98085
  chr7:77315389-77315482
  Hypo

SEQ ID NO: 127923 - DNA, 35 bp, Homo sapiens; identical to SEQ ID NO: 98086
  chr7:77324362-77324397
  Hypo

SEQ ID NO: 127924 - DNA, 30 bp, Homo sapiens; identical to SEQ ID NO: 98087
  chr7:77413267-77413297
  Hypo

SEQ ID NO: 127925 - DNA, 28 bp, Homo sapiens
  chr7:77928410-77928438
  Hypo
aggcgtgagctaccgtgcctggctataa

SEQ ID NO: 127926 - DNA, 97 bp, Homo sapiens; identical to SEQ ID NO: 98089
  chr7:78598432-78598529
  Hypo

SEQ ID NO: 127927 - DNA, 36 bp, Homo sapiens; identical to SEQ ID NO: 98090
  chr7:78598589-78598625
  Hypo

SEQ ID NO: 127928 - DNA, 147 bp, Homo sapiens; identical to SEQ ID NO: 98091
  chr7:79081745-79081892
  Hyper

SEQ ID NO: 127929 - DNA, 420 bp, Homo sapiens; identical to SEQ ID NO: 31327
  chr7:79082159-79082579
  Hyper

SEQ ID NO: 127930 - DNA, 991 bp, Homo sapiens
  chr7:79083020-79084011
  Hyper
cactcctgcgtggtgcgagtgggaacgcgcgcgcgcgcctgggtgtgtgttgttagctgatatccatggcagctgcagtggcagggtgcgtgtgcgtgtgtgtgtgtgtgtgtgtgtgtactagttctactgtactggcagacgggaggaggcaggggaggaggggcgcgcgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaatttagcggacggctgcggttgtctggtgaaaggctatccaaggataaggggcttcacttttcccaagtaggggaaagagaaggggtctacagggctaggggtggagggagcggatgcagtgagcagcctccgcagagaaattgacaatttaaccagggacctgcggcagagacaaggc

SEQ ID NO: 127931 - DNA, 56 bp, Homo sapiens; identical to SEQ ID NO: 98095
  chr7:79764157-79764213
  Hyper

SEQ ID NO: 127932 - DNA, 241 bp, Homo sapiens; identical to SEQ ID NO: 98096
  chr7:79764471-79764712
  Hyper

SEQ ID NO: 127933 - DNA, 285 bp, Homo sapiens; identical to SEQ ID NO: 98097
  chr7:79764928-79765213
  Hyper

SEQ ID NO: 127934 - DNA, 42 bp, Homo sapiens; identical to SEQ ID NO: 98098
  chr7:80134959-80135001
  Hypo

SEQ ID NO: 127935 - DNA, 183 bp, Homo sapiens; identical to SEQ ID NO: 98099
  chr7:80135488-80135671
  Hypo

SEQ ID NO: 127936 - DNA, 37 bp, Homo sapiens; identical to SEQ ID NO: 98101
  chr7:80702421-80702458
  Hypo

SEQ ID NO: 127937 - DNA, 120 bp, Homo sapiens; identical to SEQ ID NO: 98102
  chr7:80790105-80790225
  Hypo

SEQ ID NO: 127938 - DNA, 30 bp, Homo sapiens; identical to SEQ ID NO: 98105
  chr7:80896305-80896335
  Hypo

SEQ ID NO: 127939 - DNA, 37 bp, Homo sapiens; identical to SEQ ID NO: 98106
  chr7:81644079-81644116
  Hypo

SEQ ID NO: 127940 - DNA, 30 bp, Homo sapiens; identical to SEQ ID NO: 98107
  chr7:81928003-81928033
  Hypo

SEQ ID NO: 127941 - DNA, 697 bp, Homo sapiens
  chr7:82072006-82072703
  Hyper
ttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaacttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccagcggcgagcggcgcgcaccgcctgcccggcgtctccgcatccgagcctggctccccggccgctcgctccccacccccacgggcggaaaagccccgcgactcgggaaccgacccccacccccaactcccgcggcgcccctcggccggcgctccctgcccggcccgccgacttacgtgacggccgaagggaacggctc

SEQ ID NO: 127942 - DNA, 44 bp, Homo sapiens; identical to SEQ ID NO: 98111
  chr7:82073054-82073098
  Hyper

SEQ ID NO: 127943 - DNA, 59 bp, Homo sapiens; identical to SEQ ID NO: 31334
  chr7:82791978-82792037
  Hyper

SEQ ID NO: 127944 - DNA, 34 bp, Homo sapiens; identical to SEQ ID NO: 31335
  chr7:83277925-83277959
  Hyper

SEQ ID NO: 127945 - DNA, 53 bp, Homo sapiens; identical to SEQ ID NO: 98114
  chr7:83278217-83278270
  Hyper

SEQ ID NO: 127946 - DNA, 71 bp, Homo sapiens; identical to SEQ ID NO: 31337
  chr7:83824239-83824310
  Hyper

SEQ ID NO: 127947 - DNA, 30 bp, Homo sapiens; identical to SEQ ID NO: 98123
  chr7:84773311-84773341
  Hypo

SEQ ID NO: 127948 - DNA, 409 bp, Homo sapiens
  chr7:84814630-84815039
  Hyper
ggagatcctccccctcgtctctgcgcgcccccaccccgccatcccccgctagcgcacacatgcaggagaaccctttttaggctaaaccggaaagtttaggtcttctcccctcttcttttgcttgtgcaaatagcactaagctaaacggaaagtggtggggttttggtgatgaaataagagtccacgcacagaagcttgccttttattaccgcttcgctcgaggcgaaatcgctgaaagttcggctatttaactcctgtccccataactcggaatcccggacaccagcggccccagctgctggcgcgcggctctcttccagtcccctggatcccaaagctccctgccacagcgcggcgtctcctcctcctgtcaacttccctccttgcactgtgacggaggcaaagcaac

SEQ ID NO: 127949 - DNA, 101 bp, Homo sapiens
  chr7:84815350-84815451
  Hyper
ttccatcagacggaacgtcgcgattccccggcgaagaaaaaggcgtcgcccattcctcttccaaaacgctacaacaaaaaccaccacgcttcccttccttc

SEQ ID NO: 127950 - DNA, 771 bp, Homo sapiens
  chr7:84815717-84816488
  Hyper
ctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccacccccaaatcccggctatccccgcttagcaccgcggtctccagcacaccctcccactggagtagcaggtgacccaaaccagacttacctgctgtgaactcttctctccctctctcttttcctggtgccttttcagggagaggggaacgggatgcaggctgaggtccagcggcgcggcaacccggggcaccggcgcgcgttcctctgagccgcagccctggctgagcaagcggagccgccggcagccctggcagagccgggaagctgcggccgcaggggccaggccgggaggcagggggcgctgctgcctcccccgagagccgcgctaggacaggcggagagcaaggcaccagctggagctttggggaggagagggtggcgaggaaaggcacgctccaaacaggagggcggcttttaagtttgtggtgtgaccgcagcagctgtcctgggagagactcagtctttctaaaaagaggatgctgaaaacgccggggattacctttccccttccgatctcctcccccagccctcgccccctccttccactgcgcacgccagaactcccaagcgtgcagaagttcat

SEQ ID NO: 127951 - DNA, 23 bp, Homo sapiens
  chr7:84936791-84936814
  Hypo
accgcgctcggccttgtttacca

SEQ ID NO: 127952 - DNA, 28 bp, Homo sapiens
  chr7:85220892-85220920
  Hypo
gatctaggccgggagcggtggctcacgc

SEQ ID NO: 127953 - DNA, 27 bp, Homo sapiens
  chr7:86228129-86228156
  Hypo
aggaggctgaatccacggggctgagca

SEQ ID NO: 127954 - DNA, 1238 bp, Homo sapiens
  chr7:86273208-86274446
  Hyper
ccctctccaggggctcgcagtgtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggtaagggtcccagaggaggacgtgtccctctggagggcgcccagccagggcgcggaagctcgggtgccgcgtggggcaggcgcagccgggaaagttgaggtagagcatggaccagtccctacagtcctgactggagtgggaagggtggagggcagaggcgatgtgggtgtgcatgagtgagagtttgtgtgtgtgcgcccacgtctgtgtctgggaggagggagatttcagggcatagatctgcggccagggtgcgag

SEQ ID NO: 127955 - DNA, 42 bp, Homo sapiens; identical to SEQ ID NO: 41364
  chr7:86416083-86416125
  Hypo

SEQ ID NO: 127956 - DNA, 102 bp, Homo sapiens; identical to SEQ ID NO: 98142
  chr7:86688425-86688527
  Hyper

SEQ ID NO: 127957 - DNA, 627 bp, Homo sapiens; identical to SEQ ID NO: 98143
  chr7:87104741-87105368
  Hyper

SEQ ID NO: 127958 - DNA, 1146 bp, Homo sapiens
  chr7:87229377-87230523
  Hyper
aaattactcaaatctcgcaactatgtaaactatgaaaatgaaacaagctagttaccttttattgttcagtttaaaaaagttcttcttctttgctcctccattgcggtccccttcaagatccattccgacctgaagagaaaccgcagctcattagccaaatgcatgagcctcaggcgcgctggaggtgagactaacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagctcctgagtctagatctaaccccacttggtccccatggacttgccagaggacttcacactatccacgcctcaagaagcccttctcccgtgaagaccaagttcaggaaatctgaaagcctgacacttgggaactgtcccatagtagctcccagctttgcgtgcccctacctcgcgctccttggaacggccaccaagacgtgaaattttggaagaagatactccgactttagtggaaagacctaaaggaaacgaacagcggcctctgcttctttgagcttggaagagccgctactcgaatgagctcaggcttcctgtggcaaagagagcgaagcggctgtgctcagcccacgccccggcgctgttcctgcccagccaatcagcctcaccacagatgactgctcccggcccggattgactgaatgctgattcctcgagaaactgcgaaacaggttgaatttccaggaggaatgttctggcttccgttgcacctctctagaaagggcaagtagagaaacgcgcatcagctgaatcattggggacatttcaacttatgtagacacgtctttcaaagttcacataagtcttcatatccatataactacaggacgtagttaagggaaa

SEQ ID NO: 127959 - DNA, 983 bp, Homo sapiens
  chr7:87256912-87257895
  Hyper
ctcctgcaggtaaaacggtgggtagtgagaagctctaggaagggggcgcttccgaacacgcgcgtcgaggagggcgttccaggactctgagggagcagcccagctggaccgaggccgcgtcgttcctgggcttactattcccagacccggactcccgattccggagtcacggcccaggacgcgaaaagactctacactggcaccacgctcctccttaggcgggccgtcagtcccgggtgcgggctgcgctggaggctgaggtgggagcgacatggtgtggaggggcaagaaatgtcggcactagacgcgccaagaaggagattctacgagcaattcccccctcgggccattgtgttgctgtttattagcccctgggagggcgtcaggacaaaaggaaccctcctcccttcttagtacttaggcccaaggtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatccccgcggctagcctgtgtggctactggcggcagctagcgggctgcgaaagcgagcccagcgtccttgacagcagcccacgcgtcggggcggggcttgagcccgctgctttaaaaggtccgcgcggccggccccgcccctctggtgccgcgattggatccggcgggggtagcgttgatttgataggcgcagagagggtggggctgcgcacgcgaggccgggggccttgccgctgcctcccgggctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtg

SEQ ID NO: 127960 - DNA, 443 bp, Homo sapiens; identical to SEQ ID NO: 98149
  chr7:87257955-87258398
  Hyper

SEQ ID NO: 127961 - DNA, 30 bp, Homo sapiens; identical to SEQ ID NO: 98150
  chr7:87564329-87564359
  Hyper

SEQ ID NO: 127962 - DNA, 49 bp, Homo sapiens; identical to SEQ ID NO: 98151
  chr7:87564603-87564652
  Hyper

SEQ ID NO: 127963 - DNA, 30 bp, Homo sapiens; identical to SEQ ID NO: 98152
  chr7:87850928-87850958
  Hypo

SEQ ID NO: 127964 - DNA, 86 bp, Homo sapiens; identical to SEQ ID NO: 98153
  chr7:87936120-87936206
  Hyper

SEQ ID NO: 127965 - DNA, 58 bp, Homo sapiens; identical to SEQ ID NO: 98154
  chr7:88387729-88387787
  Hyper

SEQ ID NO: 127966 - DNA, 42 bp, Homo sapiens; identical to SEQ ID NO: 98155
  chr7:88387989-88388031
  Hyper

SEQ ID NO: 127967 - DNA, 1014 bp, Homo sapiens
  chr7:88388282-88389296
  Hyper
gctcattcttgcaaccggctggggagctgttgcttctgccaacgccgccgtcagccagagcgctgaagaaaagctgaaggccagcaggcaacgaaagagtaaagaaaacgccctcctcctgcccatctcctccaccacagcctccccagtcctcccaggtgactcccaaacagtagaaagttggctcagagatagggcagaagaaccggggggctgggcggctgaggccgggaggtgggagaggcgggtcctgcagccccgagagccccccgcggctgcagcggcagctgtcacctcctggcctcgccccacagcacacctgagcctcctgggcagccccgagcccacagctcccagcagaggcgctaactgccctcctcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggct

SEQ ID NO: 127968 - DNA, 552 bp, Homo sapiens
  chr7:89748011-89748563
  Hyper
cgggcactgactgtccgatacctcagcgatcgtaggagagcagagacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggcggcgcgcggggaagctactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgg

SEQ ID NO: 127969 - DNA, 41 bp, Homo sapiens; identical to SEQ ID NO: 98162
  chr7:89748925-89748966
  Hyper

SEQ ID NO: 127970 - DNA, 239 bp, Homo sapiens
  chr7:89841157-89841396
  Hyper
tcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcg

SEQ ID NO: 127971 - DNA, 539 bp, Homo sapiens; identical to SEQ ID NO: 31364
  chr7:89950183-89950722
  Hyper

SEQ ID NO: 127972 - DNA, 312 bp, Homo sapiens; identical to SEQ ID NO: 98166
  chr7:90225745-90226057
  Hyper

SEQ ID NO: 127973 - DNA, 478 bp, Homo sapiens
  chr7:90226268-90226746
  Hyper
ggttctcccctcctccgccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgttcagtctcgaggtctctgaatcttcccgctgctggagagaaatgcgcgctgtggagttgtctggacatttaggaatgtctctcgaacttgttccatttaatagagctcaggggctgttgtctttaaaccaaacaacaaaccaactgaccaacagtgtttaggacagtgacgaataaatgcatgt

SEQ ID NO: 127974 - DNA, 76 bp, Homo sapiens; identical to SEQ ID NO: 98169
  chr7:90269559-90269635
  Hypo

SEQ ID NO: 127975 - DNA, 146 bp, Homo sapiens; identical to SEQ ID NO: 98170
  chr7:90558629-90558775
  Hypo

SEQ ID NO: 127976 - DNA, 30 bp, Homo sapiens; identical to SEQ ID NO: 98171
  chr7:90720178-90720208
  Hypo

SEQ ID NO: 127977 - DNA, 220 bp, Homo sapiens
  chr7:90894938-90895158
  Hyper
cagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacc

SEQ ID NO: 127978 - DNA, 45 bp, Homo sapiens; identical to SEQ ID NO: 98175
  chr7:91510048-91510093
  Hyper

SEQ ID NO: 127979 - DNA, 48 bp, Homo sapiens; identical to SEQ ID NO: 98176
  chr7:91510834-91510882
  Hypo

SEQ ID NO: 127980 - DNA, 467 bp, Homo sapiens; identical to SEQ ID NO: 98178
  chr7:91808202-91808669
  Hyper

SEQ ID NO: 127981 - DNA, 30 bp, Homo sapiens; identical to SEQ ID NO: 98179
  chr7:91889676-91889706
  Hypo

SEQ ID NO: 127982 - DNA, 25 bp, Homo sapiens
  chr7:92076443-92076468
  Hypo
tgagccaccacgccagacctggatt

SEQ ID NO: 127983 - DNA, 30 bp, Homo sapiens; identical to SEQ ID NO: 98182
  chr7:92439285-92439315
  Hyper

SEQ ID NO: 127984 - DNA, 329 bp, Homo sapiens
  chr7:92466152-92466481
  Hyper
aaattaaagccttccggagagaaatgaggcggccgagtcccggcagtgctccgagctccgggctccctagctcccttctacgagtcgggggctagaagggcgcggtgggggtgggggtgggggggagagttaaatgaaaatttccggctttcgctgaaactgtagtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaaca

SEQ ID NO: 127985 - DNA, 464 bp, Homo sapiens; identical to SEQ ID NO: 98184
  chr7:92689310-92689774
  Hypo

SEQ ID NO: 127986 - DNA, 30 bp, Homo sapiens; identical to SEQ ID NO: 98185
  chr7:92731846-92731876
  Hypo

SEQ ID NO: 127987 - DNA, 30 bp, Homo sapiens; identical to SEQ ID NO: 98186
  chr7:92732475-92732505
  Hypo

SEQ ID NO: 127988 - DNA, 30 bp, Homo sapiens; identical to SEQ ID NO: 41367
  chr7:93055830-93055860
  Hypo

SEQ ID NO: 127989 - DNA, 235 bp, Homo sapiens; identical to SEQ ID NO: 98188
  chr7:93203561-93203796
  Hyper

SEQ ID NO: 127990 - DNA, 897 bp, Homo sapiens
  chr7:93204217-93205114
  Hyper
cgagctggtgagctccgtgcgcctcgcgccagccccagtcgccccggcccgcgagtggggctgcgctcgcggctgctgtctcgctccagtcagggctggggctcaccctgcgagtccgggagactaaagcgccgcgtaaacacaggaagcaggcgagggacccgagttagaccttgagtagggagggagaggggggcgacagtctggactgggagacagctttctgggagccctgtcccctccccggagaatgcaaattccggagggaggtgagtttccacaagaaccttatcccagagacattgtgaccctggcttcttcagccgccactccggggacagcactagggagcctgtggagggagggtcggtagtgggctaggtagtgaaagtggggtgaggacgtgggaagacggctggctaagagctggggtgctaaaaggaaaaaagtgctgagaggaaggagatgagaagagacaccttgggggtcaggcaagccctgggaaagcgtccggagttgggcggctgtaggctggaggcataacttggatttggagaaagagtgccctccgtgtaggggactgctggtgggcacagtgttttagggtgaatgaaaacagagaggatggcgagggaagacggggatatggggtgcctgacttggtgccggacactgcgactcctcttctttccccctaaagccctcgatgtcagcaggagtccgggacaatccaataccaggcggggcgcagcggaggctggcaggcacgccctgggaggcaggcaagttgattccaaggacgagtcaccctcaacctcttttagcccacaactgggtggatcaaggcaggagccaacacttttttccctaactctgtttaggcggtgttggactaag

SEQ ID NO: 127991 - DNA, 146 bp, Homo sapiens; identical to SEQ ID NO: 98192
  chr7:93511549-93511695
  Hypo

SEQ ID NO: 127992 - DNA, 1262 bp, Homo sapiens
  chr7:93519204-93520466
  Hyper
atctttccctgagtccgcacaggcactgaattatgatcaatgtcagttgggagacaggaaatgtgttagtggttgtaaatttgtgattacttttaagaaactgaaaaccatgaggtttgcttaacacttgagaaaacccaggctaaaacttcctgtagaaagcgagacgtgggaaactggcgaagctgctaccagccgccggcgcaaggagcgcgagagtcctgggtgcgcgcagggcacttactttctatcctccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggagcgagtcccccctgccagcggagcgcgcggcagggacctggagaaagcgaggcttggagggcgcctacacggggccccatggcccgctgcgccctctccgccggttggggagagaagctcctggagcggccagatacctgttggctcctgagcagcatcgcccagtgcagcctccgtcaggaaaagcagcagaatcgacagccccagggggcgagcggggtccatggtgcagggggtcgggcggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaatggacct

SEQ ID NO: 127993 - DNA, 28 bp, Homo sapiens
  chr7:93520878-93520906
  Hypo
actccagtctgggcggcagagtggaact

SEQ ID NO: 127994 - DNA, 534 bp, Homo sapiens; identical to SEQ ID NO: 98197
  chr7:93550996-93551530
  Hyper

SEQ ID NO: 127995 - DNA, 33 bp, Homo sapiens; identical to SEQ ID NO: 98198
  chr7:93605811-93605844
  Hypo

SEQ ID NO: 127996 - DNA, 37 bp, Homo sapiens; identical to SEQ ID NO: 98199
  chr7:93641681-93641718
  Hypo

SEQ ID NO: 127997 - DNA, 30 bp, Homo sapiens; identical to SEQ ID NO: 31379
  chr7:94024050-94024080
  Hyper

SEQ ID NO: 127998 - DNA, 39 bp, Homo sapiens; identical to SEQ ID NO: 98201
  chr7:94138061-94138100
  Hypo

SEQ ID NO: 127999 - DNA, 783 bp, Homo sapiens; identical to SEQ ID NO: 98202
  chr7:94284364-94285147
  Hyper

SEQ ID NO: 128000 - DNA, 751 bp, Homo sapiens; identical to SEQ ID NO: 98203
  chr7:94536847-94537598
  Hyper

SEQ ID NO: 128001 - DNA, 30 bp, Homo sapiens; identical to SEQ ID NO: 98204
  chr7:94537877-94537907
  Hyper

SEQ ID NO: 128002 - DNA, 385 bp, Homo sapiens; identical to SEQ ID NO: 98205
  chr7:95225822-95226207
  Hyper

SEQ ID NO: 128003 - DNA, 48 bp, Homo sapiens; identical to SEQ ID NO: 98206
  chr7:95401676-95401724
  Hyper

SEQ ID NO: 128004 - DNA, 420 bp, Homo sapiens; identical to SEQ ID NO: 98207
  chr7:95402025-95402445
  Hyper

SEQ ID NO: 128005 - DNA, 30 bp, Homo sapiens; identical to SEQ ID NO: 98210
  chr7:96619573-96619603
  Hyper

SEQ ID NO: 128006 - DNA, 634 bp, Homo sapiens; identical to SEQ ID NO: 98211
  chr7:96621715-96622349
  Hyper

SEQ ID NO: 128007 - DNA, 642 bp, Homo sapiens; identical to SEQ ID NO: 98212
  chr7:96625570-96626212
  Hyper

SEQ ID NO: 128008 - DNA, 126 bp, Homo sapiens; identical to SEQ ID NO: 98213
  chr7:96627308-96627434
  Hyper

SEQ ID NO: 128009 - DNA, 36 bp, Homo sapiens; identical to SEQ ID NO: 98214
  chr7:96628041-96628077
  Hyper

SEQ ID NO: 128010 - DNA, 144 bp, Homo sapiens; identical to SEQ ID NO: 98215
  chr7:96631691-96631835
  Hyper

SEQ ID NO: 128011 - DNA, 30 bp, Homo sapiens; identical to SEQ ID NO: 98216
  chr7:96632234-96632264
  Hyper

SEQ ID NO: 128012 - DNA, 30 bp, Homo sapiens; identical to SEQ ID NO: 98217
  chr7:96632789-96632819
  Hyper

SEQ ID NO: 128013 - DNA, 500 bp, Homo sapiens; identical to SEQ ID NO: 98218
  chr7:96633044-96633544
  Hyper

SEQ ID NO: 128014 - DNA, 50 bp, Homo sapiens; identical to SEQ ID NO: 31392
  chr7:96634276-96634326
  Hyper

SEQ ID NO: 128015 - DNA, 267 bp, Homo sapiens; identical to SEQ ID NO: 98220
  chr7:96634652-96634919
  Hyper

SEQ ID NO: 128016 - DNA, 1603 bp, Homo sapiens
  chr7:96635204-96636807
  Hyper
ctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctaccccgcccgcccgctcacttcctcgacgcccgggcctccgccggccccctcccccaggcggccccgcgcgcccttggccgggccccgtgcgcgcccgctcgcctggcgcctgcctgccggcctctcccagccgggccccttcccgccgccgcggaccctcagcttccgacgcgcagttcgggctgagtcccgggcccggcgcaggcttcgttcgacgagttagtccacactgcgctctccagcctcctgggtctgtgcgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttctcagcacccgagggggacaaagttgccgtgagaggcgcagcctgctcgtgggctggtctgagctgttggttgtgttttgtttgaggatttggtcctcctcaggagagtcatttcaaaacatgccgaggatgcttgatgcactgagcttggagctggtgacatcaagtcaactggccgcgtaaacacctgggtggctcaagcacagcttcaggtactgttaagccgggcacaggggccccgctccgcccggacagctgccgccttgctgcgctgcgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggacc

SEQ ID NO: 128017 - DNA, 312 bp, Homo sapiens
  chr7:96641441-96641753
  Hyper
tttttcatgtagcccgctgattacagcgtttttaccgtcaaagataattacctgtaattttcttccacttttaatactaaaaagccatctttatttagattcaggaacaggaaaggcgaaacaaaagagggaaattattctgttattcatacacaaattgcagagacgtaggacctaaaattgaaaattaaccaaaattataatgctgaaaagaatggaagaggctgcagaagtacagctggtagtggggctttgctgaattattcaaattacgttagggagaatgctaccatacatcgaaaccaacactaa

SEQ ID NO: 128018 - DNA, 106 bp, Homo sapiens; identical to SEQ ID NO: 98226
  chr7:96642021-96642127
  Hyper

SEQ ID NO: 128019 - DNA, 60 bp, Homo sapiens; identical to SEQ ID NO: 98227
  chr7:96642748-96642808
  Hyper

SEQ ID NO: 128020 - DNA, 1720 bp, Homo sapiens; identical to SEQ ID NO: 98228
  chr7:96645617-96647337
  Hyper

SEQ ID NO: 128021 - DNA, 769 bp, Homo sapiens; identical to SEQ ID NO: 98229
  chr7:96647540-96648309
  Hyper

SEQ ID NO: 128022 - DNA, 1456 bp, Homo sapiens
  chr7:96650046-96651502
  Hyper
tctaatagagtgtcccggaggccagcgccagcgggtgctgtaaggagcccggcggcggcaggtgggaattgattgagctggctgcacttgtgtaccaggatgcagagttctccaggtagctggacgctggggactggttggaggtcggagggtgggcatgagggtggtggctgagcgagcgggacgagccctggggctcccacaccgctggagactgcggcgagttacacgccattgggtcgctggagctgggactgtgctccgggggcatctccccgtttttcatgatcttcttgatcttggatcttttgttctgaaaccagattttcacctgagttggggaacaaaggcacacgttaccgggacactcagaggtcgcccgcgccttccccggggcggcgactggaggcatcttcggacctctgggcggcccagccctgcctggcgtctccccgccgcttgcggcctaccgccaagaagctatgccttaggcaaaccatggagctctggccccagagggcgccctggccggctcggggcgccccggcccagcgaggccacgaccccaaggcttgtcttttgtttgggctgggggtgggggacgccagcgcggcgggtgtgcgcccgagtgtcctcggcggcggcgcgcctcgtgtaagcctgcgcaggacgcgcggaacgcggcgaaggtctccaaaacaatcgcgcgagcccggcggggaaggggcgtggggcgggctacgcgcgcctgtggtcagaaaaaggagcgagctcccaacctcccgtcctactcccttcactccctctgcagctcagagaggccagaatctgactgcagctcttggcggcgactcgaacattctttatgcttccgtaggccccagctgggttggaggagtaaaaggaatgggacaatccaggaagacttctcacgtacaatagcgccccccacctcgcgacccttcggtggccgtggcctgaagctcccgtaggctcagggcacgacccttcagtttctccgctccaggcgacgttctcagccttttcttagcctgagaccaccgcgagaacaccaggccttgctcacccccgaggaggctctacattgttaagaaaaccagatagctgctctgggctgcctaggccgccctagaaataaccctccgcttgctttcaacccgcgaaattggccccacagctccggaggcccgctacggggtgggggcggggggcgcggttagtgggaggtatctccagaccgctgatgaataccatccccaccgtctcaaggcctgactcaccgagttaaagcataggggctgatgtctttgggtctgttagtttctcacgggtactgtcaaaacagctccagtcccatcgagactgaaccgcgcgacccaaccagacgtgcagctcaggcaggtctagtgcatggcagcgccgtatttacctgtgt

SEQ ID NO: 128023 - DNA, 585 bp, Homo sapiens
  chr7:96651845-96652430
  Hyper
ccaaatatggaaaagcgggatagcctctgattaattcctactctgttcattcagatagtttgtgcaaagcgcttcctacaacactgctttctccttggcatctgggattcagctcttgcggtcgttgcttcttctcccggacttgtttttacgcccaccctgtgctcctccgcgtttccgcccctccccaggcttcaagaacaccagcccctccccaggcttcaaggaggtggccctgggccgtgaccctacttctgtcggcgtctgttcgggcgcccgcagaagccagactcttgggcagggaagacgctaaccgaggtctccaaagttcaaagacccacaagcaaactgctccttcacttcagcagcaagcggtcggggccgccgcagacagagggtcgattatgcaacccccataatctcgctgcagatctgcgagggcacagatgtgtctggtttcttttacaaatagacttaatatgttcttggcaaaaaaaaaaaaaaaaaaaagaaatcttccacttatgcacggaatacagagagagtgaaagaaacgtagacacctcaacccggggctctctttta

SEQ ID NO: 128024 - DNA, 30 bp, Homo sapiens; identical to SEQ ID NO: 98235
  chr7:96652891-96652921
  Hyper

SEQ ID NO: 128025 - DNA, 984 bp, Homo sapiens
  chr7:96653182-96654166
  Hyper
cgcaccaacccagcacgcttaccaaaattcccaagtaaccttctctttgttacgcaaacgccaggagctgcttgattctttcttctctccacccctatcccctttccagcctagccggcttcctggccgggcaagctgggaattcagcgactgaagggccttggaaggtgccggaggggagagacgctagttcgaacctccacagggctctcctactaaaaatccctaaaatgctggcccgagaaactctctttgttggagggtctgagtcctactcccttctgccgcgtgcgcccccactgccgtgaaccgctgtgacccccaatctaccaccccatctcgcgcccccagcgtcctagtcgccctgtatctgcccagccttccccctgtccatgtacctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagactcgggcaaagttggcgattcctgagacggatggtgcatagctgcggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggaggaagaggaggaggagagaaggaggaggcggcggccgcggcgaggaggagactgggagtcgtgaagtctctgtctccggccggctgactgctggctgaggcgcagcacagccttg

SEQ ID NO: 128026 - DNA, 83 bp, Homo sapiens; identical to SEQ ID NO: 31408
  chr7:96656775-96656858
  Hyper

SEQ ID NO: 128027 - DNA, 39 bp, Homo sapiens; identical to SEQ ID NO: 98240
  chr7:96747112-96747151
  Hyper

SEQ ID NO: 128028 - DNA, 22 bp, Homo sapiens
  chr7:96968265-96968287
  Hypo
gccaccgcgcctggccctattt

SEQ ID NO: 128029 - DNA, 26 bp, Homo sapiens
  chr7:97234138-97234164
  Hypo
gccaccgcgcccggccaatacaatga

SEQ ID NO: 128030 - DNA, 776 bp, Homo sapiens
  chr7:97361005-97361781
  Hyper
tgcaacttatcctgacgtctcgagggacggaaaagttaccgaagtccaaggaatgagtcactttgctcaaatttgatgagtaatatcaggtgtcatgaaacccagtttcgaaggagaggggagggggcgtcagatctgcagacggaagcaggccgctccggattggatggcgagacctcgattttcctaaaattgcgtcatttagaacccaattgggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcagtaagtgcccgcgcggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagac

SEQ ID NO: 128031 - DNA, 1129 bp, Homo sapiens
  chr7:97362187-97363316
  Hyper
aggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagccggcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaag

SEQ ID NO: 128032 - DNA, 120 bp, Homo sapiens; identical to SEQ ID NO: 98247
  chr7:97589532-97589652
  Hypo

SEQ ID NO: 128033 - DNA, 242 bp, Homo sapiens; identical to SEQ ID NO: 98248
  chr7:97591231-97591473
  Hypo

SEQ ID NO: 128034 - DNA, 136 bp, Homo sapiens; identical to SEQ ID NO: 98249
  chr7:97600089-97600225
  Hypo

SEQ ID NO: 128035 - DNA, 76 bp, Homo sapiens; identical to SEQ ID NO: 98250
  chr7:97600285-97600361
  Hypo

SEQ ID NO: 128036 - DNA, 25 bp, Homo sapiens
  chr7:97602847-97602872
  Hypo
tctccgcctgattgacggaatgaac

SEQ ID NO: 128037 - DNA, 78 bp, Homo sapiens; identical to SEQ ID NO: 98252
  chr7:97627595-97627673
  Hypo

SEQ ID NO: 128038 - DNA, 151 bp, Homo sapiens; identical to SEQ ID NO: 98254
  chr7:97680597-97680748
  Hyper

SEQ ID NO: 128039 - DNA, 30 bp, Homo sapiens; identical to SEQ ID NO: 98255
  chr7:97689387-97689417
  Hypo

SEQ ID NO: 128040 - DNA, 30 bp, Homo sapiens; identical to SEQ ID NO: 98257
  chr7:97738118-97738148
  Hypo

SEQ ID NO: 128041 - DNA, 102 bp, Homo sapiens; identical to SEQ ID NO: 98258
  chr7:97797696-97797798
  Hypo

SEQ ID NO: 128042 - DNA, 30 bp, Homo sapiens; identical to SEQ ID NO: 41372
  chr7:97804272-97804302
  Hypo

SEQ ID NO: 128043 - DNA, 30 bp, Homo sapiens; identical to SEQ ID NO: 41373
  chr7:97807742-97807772
  Hypo

SEQ ID NO: 128044 - DNA, 134 bp, Homo sapiens; identical to SEQ ID NO: 98261
  chr7:97834167-97834301
  Hypo

SEQ ID NO: 128045 - DNA, 41 bp, Homo sapiens; identical to SEQ ID NO: 98262
  chr7:97839783-97839824
  Hypo

SEQ ID NO: 128046 - DNA, 30 bp, Homo sapiens; identical to SEQ ID NO: 98263
  chr7:97844525-97844555
  Hypo

SEQ ID NO: 128047 - DNA, 144 bp, Homo sapiens; identical to SEQ ID NO: 98264
  chr7:97844894-97845038
  Hypo

SEQ ID NO: 128048 - DNA, 57 bp, Homo sapiens; identical to SEQ ID NO: 98265
  chr7:97846981-97847038
  Hypo

SEQ ID NO: 128049 - DNA, 87 bp, Homo sapiens; identical to SEQ ID NO: 98266
  chr7:97852229-97852316
  Hypo

SEQ ID NO: 128050 - DNA, 30 bp, Homo sapiens; identical to SEQ ID NO: 98267
  chr7:97852802-97852832
  Hypo

SEQ ID NO: 128051 - DNA, 31 bp, Homo sapiens; identical to SEQ ID NO: 98268
  chr7:97869134-97869165
  Hypo

SEQ ID NO: 128052 - DNA, 330 bp, Homo sapiens; identical to SEQ ID NO: 98269
  chr7:97869405-97869735
  Hypo

SEQ ID NO: 128053 - DNA, 42 bp, Homo sapiens; identical to SEQ ID NO: 41377
  chr7:97882348-97882390
  Hypo

SEQ ID NO: 128054 - DNA, 77 bp, Homo sapiens; identical to SEQ ID NO: 98272
  chr7:97899729-97899806
  Hypo

SEQ ID NO: 128055 - DNA, 30 bp, Homo sapiens; identical to SEQ ID NO: 98273
  chr7:97917070-97917100
  Hypo

SEQ ID NO: 128056 - DNA, 65 bp, Homo sapiens; identical to SEQ ID NO: 98274
  chr7:97925156-97925221
  Hypo

SEQ ID NO: 128057 - DNA, 30 bp, Homo sapiens; identical to SEQ ID NO: 98275
  chr7:98088677-98088707
  Hypo

SEQ ID NO: 128058 - DNA, 22 bp, Homo sapiens
  chr7:98121341-98121363
  Hypo
agaaattaacagggccgggcgc

SEQ ID NO: 128059 - DNA, 62 bp, Homo sapiens; identical to SEQ ID NO: 98277
  chr7:98121881-98121943
  Hypo

SEQ ID NO: 128060 - DNA, 30 bp, Homo sapiens; identical to SEQ ID NO: 98278
  chr7:98122148-98122178
  Hypo

SEQ ID NO: 128061 - DNA, 198 bp, Homo sapiens; identical to SEQ ID NO: 15009
  chr7:98183080-98183278
  Hypo

SEQ ID NO: 128062 - DNA, 2043 bp, Homo sapiens
  chr7:98245805-98247848
  Hyper
cgcccagggggcagtcgatgaacacgcgcgcgagggctctgcgagtggcctcgtgactttgtccctaactccgggtgtcccctccttcccatcagcgtccggcgcctggtcctggtcccggtccccgaggcccccgggattcttcccgagcgttttccgagttggcgcggggggtggaggcggggccatggagcgcgtcccggggaccgttgcatccggaggcggccgtcgtgcggctccttcccgcctcgagagtgaggtggccgggccttgacgagaaggcccacgcctgccgcgggggtggctcgcgatggcagtcggggttcgagtcccgcctggggggctgctcctgctggagaaaacgcctccctgagggcggcggcaaacgcgcagcgaggccccgtgccgcgccagaagccaccctgagaaaggggcaccgggacaccgaggggttcccactttctcctcagcctgtgacgcccgcgtcctcgggtgggttcgaggggcgcctgggcacggccagccgaggctctcgagagccccagtgtcgttttccacctcaggcctcctttcctgaggcagagcccgggacctcgcgctctcgcctcaggctccggcccacgctcccgcccggccgccaggcgcgcaacggaaagcgcccccgccccgccccgctccgcccactgcgtgacgcgcacccggccgagccaatcagagctcgtggcgcgcgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctccgcgagccgggatgcgctcccgcaggccgtgcgggttgctgcgaggctgccgcgggaggtcagctgccccgggcatgtggtgtttctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggg

SEQ ID NO: 128063 - DNA, 109 bp, Homo sapiens; identical to SEQ ID NO: 98284
  chr7:98635920-98636029
  Hypo

SEQ ID NO: 128064 - DNA, 30 bp, Homo sapiens; identical to SEQ ID NO: 98285
  chr7:98964581-98964611
  Hypo

SEQ ID NO: 128065 - DNA, 30 bp, Homo sapiens; identical to SEQ ID NO: 98286
  chr7:98966380-98966410
  Hypo

SEQ ID NO: 128066 - DNA, 95 bp, Homo sapiens; identical to SEQ ID NO: 98287
  chr7:98970776-98970871
  Hypo

SEQ ID NO: 128067 - DNA, 80 bp, Homo sapiens; identical to SEQ ID NO: 98288
  chr7:98971520-98971600
  Hypo

SEQ ID NO: 128068 - DNA, 316 bp, Homo sapiens; identical to SEQ ID NO: 98289
  chr7:98991466-98991782
  Hypo

SEQ ID NO: 128069 - DNA, 403 bp, Homo sapiens; identical to SEQ ID NO: 98290
  chr7:99020763-99021166
  Hypo

SEQ ID NO: 128070 - DNA, 31 bp, Homo sapiens; identical to SEQ ID NO: 98291
  chr7:99101324-99101355
  Hypo

SEQ ID NO: 128071 - DNA, 185 bp, Homo sapiens; identical to SEQ ID NO: 98292
  chr7:99103865-99104050
  Hypo

SEQ ID NO: 128072 - DNA, 35 bp, Homo sapiens; identical to SEQ ID NO: 98293
  chr7:99104258-99104293
  Hypo

SEQ ID NO: 128073 - DNA, 247 bp, Homo sapiens; identical to SEQ ID NO: 98294
  chr7:99149175-99149422
  Hyper

SEQ ID NO: 128074 - DNA, 849 bp, Homo sapiens
  chr7:99155751-99156600
  Hyper
gacctactgagatttcgatcccacaacttagtgggtcccatctcacccaggccccgcaatcctcgccttctacttgtcagcgttgtactacactctgagcaggcacccctgtgctactcacggaagcgggaccattaggtcggccattcctcctcaccccacgacacgcacccactgggtcgggccgcctccttgcagggagtctcaaggatgggctggcgtcagggaggggcccagggggcgctttcccaacactggtcgcagtcattgttggtataacggctagagacgcccagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggcc

SEQ ID NO: 128075 - DNA, 167 bp, Homo sapiens; identical to SEQ ID NO: 98298
  chr7:99156815-99156982
  Hyper

SEQ ID NO: 128076 - DNA, 617 bp, Homo sapiens
  chr7:99177666-99178283
  Hyper
ggttcacatggggaccgtggcgatgacacggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagagactccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatc

SEQ ID NO: 128077 - DNA, 31 bp, Homo sapiens; identical to SEQ ID NO: 98302
  chr7:99591731-99591762
  Hypo

SEQ ID NO: 128078 - DNA, 461 bp, Homo sapiens
  chr7:99595183-99595644
  Hyper
cttttgactcattttgaggcccccgtcgtagggtacacgccctgggaatcgggggtcttccagtatagggaaccaccgagatgcgggccctccgaagtcctagagagggcgcctcggccgccggcacccgccacacttccggcctttgtgggccgcagcgacggcggtctgcggctgtcggttctgtttgttgctgtcactgctgtttgttcttgccagcggctaggtgtgtagttgcttggggctcctagcacgaggcctctgtccccaggcacgcagcgccagtctccggctgttgcgccctgggcgccgcctctctccggcccccctttgtttcctgagccagctgggaagactaaaagggtgggtcctgggagcggcccatggttcgacccttcttttcaggcatccttggagcatgcaggctgcagatttcaggccgaccccgctagcaccaaagt

SEQ ID NO: 128079 - DNA, 21 bp, Homo sapiens
  chr7:99648525-99648546
  Hypo
atttgtgtggccgggcgcggt

SEQ ID NO: 128080 - DNA, 24 bp, Homo sapiens
  chr7:99649202-99649226
  Hypo
ccacggcgccgggccccctaggga

SEQ ID NO: 128081 - DNA, 43 bp, Homo sapiens; identical to SEQ ID NO: 41387
  chr7:99691859-99691902
  Hypo

SEQ ID NO: 128082 - DNA, 85 bp, Homo sapiens; identical to SEQ ID NO: 98308
  chr7:99700198-99700283
  Hypo

SEQ ID NO: 128083 - DNA, 156 bp, Homo sapiens; identical to SEQ ID NO: 98309
  chr7:99723084-99723240
  Hypo

SEQ ID NO: 128084 - DNA, 49 bp, Homo sapiens; identical to SEQ ID NO: 98310
  chr7:99725588-99725637
  Hyper

SEQ ID NO: 128085 - DNA, 30 bp, Homo sapiens; identical to SEQ ID NO: 98311
  chr7:99736081-99736111
  Hypo

SEQ ID NO: 128086 - DNA, 30 bp, Homo sapiens; identical to SEQ ID NO: 98312
  chr7:99745367-99745397
  Hypo

SEQ ID NO: 128087 - DNA, 30 bp, Homo sapiens; identical to SEQ ID NO: 98313
  chr7:99751448-99751478
  Hypo

SEQ ID NO: 128088 - DNA, 29 bp, Homo sapiens
  chr7:99775192-99775221
  Hyper
tccggctcaaaaggcggggcctgggtgga

SEQ ID NO: 128089 - DNA, 41 bp, Homo sapiens; identical to SEQ ID NO: 41390
  chr7:99839918-99839959
  Hypo

SEQ ID NO: 128090 - DNA, 25 bp, Homo sapiens
  chr7:99934958-99934983
  Hypo
tgagccaccacgcccagctgccttg

SEQ ID NO: 128091 - DNA, 30 bp, Homo sapiens; identical to SEQ ID NO: 96039
  chr7:100035094-100035124
  Hypo

SEQ ID NO: 128092 - DNA, 19 bp, Homo sapiens
  chr7:100047876-100047895
  Hypo
ctcccgaaatgtcaggatt

SEQ ID NO: 128093 - DNA, 191 bp, Homo sapiens; identical to SEQ ID NO: 96041
  chr7:100088128-100088319
  Hypo

SEQ ID NO: 128094 - DNA, 404 bp, Homo sapiens
  chr7:100091127-100091531
  Hyper
ggagccagcagaggccgttggggggcaagcaaggacttgcttctgaggggagacgtgggtctcggcagtgcggacccgtccggtcatgctgaggtccccgaccttacccgcgttttcctttctcccccgcccgcggcacagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgg

SEQ ID NO: 128095 - DNA, 95 bp, Homo sapiens; identical to SEQ ID NO: 96043
  chr7:100104078-100104173
  Hypo

SEQ ID NO: 128096 - DNA, 30 bp, Homo sapiens; identical to SEQ ID NO: 41394
  chr7:100118785-100118815
  Hypo

SEQ ID NO: 128097 - DNA, 242 bp, Homo sapiens; identical to SEQ ID NO: 96045
  chr7:100167379-100167621
  Hyper

SEQ ID NO: 128098 - DNA, 194 bp, Homo sapiens; identical to SEQ ID NO: 96046
  chr7:100167860-100168054
  Hyper

SEQ ID NO: 128099 - DNA, 39 bp, Homo sapiens; identical to SEQ ID NO: 96047
  chr7:100170295-100170334
  Hypo

SEQ ID NO: 128100 - DNA, 30 bp, Homo sapiens; identical to SEQ ID NO: 96048
  chr7:100173832-100173862
  Hypo

SEQ ID NO: 128101 - DNA, 266 bp, Homo sapiens; identical to SEQ ID NO: 96049
  chr7:100179674-100179940
  Hypo

SEQ ID NO: 128102 - DNA, 39 bp, Homo sapiens; identical to SEQ ID NO: 96050
  chr7:100207977-100208016
  Hypo

SEQ ID NO: 128103 - DNA, 422 bp, Homo sapiens
  chr7:100253710-100254132
  Hyper
agggcaccctcccgacgggaaaggaaggggcccggggccaggtggaggtgggttgcaaggtagggccctgtgcgcgcggggcgtctggggaggaccgagcgcaggggtggcgggagacccgagcctgagactcgacccgctcgtgcgcggaggtgacaggccccggggtgcccagagctcggatggatggcgcgggtttggaacgcagggctgcgggagccgggggcccgaggctcgctcacctccgccgtagacgcccccgctcatagtgcccgctgcgctgctagcggcccgtgggcggtggcgggatcagcaccgaggcggccggacagctcccgggatccctggcggggcgggactctcagcggccaattgggaggccggatcccccgctccaacggcgccgccgattggctgccagg

SEQ ID NO: 128104 - DNA, 91 bp, Homo sapiens; identical to SEQ ID NO: 96053
  chr7:100254614-100254705
  Hypo

SEQ ID NO: 128105 - DNA, 23 bp, Homo sapiens
  chr7:100269563-100269586
  Hypo
ccccatctcgttctttcttatgg

SEQ ID NO: 128106 - DNA, 119 bp, Homo sapiens; identical to SEQ ID NO: 96055
  chr7:100279900-100280019
  Hypo

SEQ ID NO: 128107 - DNA, 120 bp, Homo sapiens; identical to SEQ ID NO: 96056
  chr7:100296125-100296245
  Hypo

SEQ ID NO: 128108 - DNA, 644 bp, Homo sapiens
  chr7:100318091-100318735
  Hyper
ctttcccagatagcacgctccgccagtcccaagggtgcgcaaccggctgcactcccctcccgcgacccagggcccgggagcagcccccatgacccacacgcacgtctgcagcagccccgctcacgccccggcgagcctcaacccaggcgtcctgcccctgctctgaccccgggtggcccctacccctggcgacccctcacgcacacagcctctcccccacccccacccgcgcacgcacacatgcagataacagccccgacccccggccagagccgcagagtccctgggccaccccggccgctcgctgcgctgcgccgcaccgcgctgtcctcccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggac

SEQ ID NO: 128109 - DNA, 39 bp, Homo sapiens; identical to SEQ ID NO: 41397
  chr7:100391505-100391544
  Hypo

SEQ ID NO: 128110 - DNA, 51 bp, Homo sapiens; identical to SEQ ID NO: 96060
  chr7:100425811-100425862
  Hyper

SEQ ID NO: 128111 - DNA, 112 bp, Homo sapiens; identical to SEQ ID NO: 96061
  chr7:100459369-100459481
  Hypo

SEQ ID NO: 128112 - DNA, 30 bp, Homo sapiens; identical to SEQ ID NO: 96062
  chr7:100485916-100485946
  Hypo

SEQ ID NO: 128113 - DNA, 456 bp, Homo sapiens; identical to SEQ ID NO: 96063
  chr7:100489889-100490345
  Hypo

SEQ ID NO: 128114 - DNA, 353 bp, Homo sapiens; identical to SEQ ID NO: 96064
  chr7:100494408-100494761
  Hyper

SEQ ID NO: 128115 - DNA, 37 bp, Homo sapiens; identical to SEQ ID NO: 96065
  chr7:100495406-100495443
  Hypo

SEQ ID NO: 128116 - DNA, 19 bp, Homo sapiens
  chr7:100606618-100606637
  Hypo
gccacggcacccggccggg

SEQ ID NO: 128117 - DNA, 72 bp, Homo sapiens; identical to SEQ ID NO: 96067
  chr7:100608819-100608891
  Hyper

SEQ ID NO: 128118 - DNA, 59 bp, Homo sapiens; identical to SEQ ID NO: 96068
  chr7:100660623-100660682
  Hyper

SEQ ID NO: 128119 - DNA, 77 bp, Homo sapiens; identical to SEQ ID NO: 96070
  chr7:100715916-100715993
  Hypo

SEQ ID NO: 128120 - DNA, 17 bp, Homo sapiens
  chr7:100723832-100723849
  Hypo
gtttgttttttgagacg

SEQ ID NO: 128121 - DNA, 124 bp, Homo sapiens; identical to SEQ ID NO: 96072
  chr7:100770176-100770300
  Hyper

SEQ ID NO: 128122 - DNA, 145 bp, Homo sapiens; identical to SEQ ID NO: 41401
  chr7:100799106-100799251
  Hypo

SEQ ID NO: 128123 - DNA, 30 bp, Homo sapiens; identical to SEQ ID NO: 96074
  chr7:100806035-100806065
  Hyper

SEQ ID NO: 128124 - DNA, 665 bp, Homo sapiens; identical to SEQ ID NO: 96075
  chr7:100807394-100808059
  Hyper

SEQ ID NO: 128125 - DNA, 113 bp, Homo sapiens; identical to SEQ ID NO: 96076
  chr7:100808389-100808502
  Hyper

SEQ ID NO: 128126 - DNA, 218 bp, Homo sapiens; identical to SEQ ID NO: 96077
  chr7:100809337-100809555
  Hyper

SEQ ID NO: 128127 - DNA, 30 bp, Homo sapiens; identical to SEQ ID NO: 96078
  chr7:100809815-100809845
  Hyper

SEQ ID NO: 128128 - DNA, 48 bp, Homo sapiens; identical to SEQ ID NO: 96079
  chr7:100813879-100813927
  Hyper

SEQ ID NO: 128129 - DNA, 30 bp, Homo sapiens; identical to SEQ ID NO: 96080
  chr7:100814949-100814979
  Hyper

SEQ ID NO: 128130 - DNA, 278 bp, Homo sapiens; identical to SEQ ID NO: 96081
  chr7:100815652-100815930
  Hyper

SEQ ID NO: 128131 - DNA, 44 bp, Homo sapiens; identical to SEQ ID NO: 96082
  chr7:100816611-100816655
  Hyper

SEQ ID NO: 128132 - DNA, 87 bp, Homo sapiens; identical to SEQ ID NO: 96083
  chr7:100817650-100817737
  Hyper

SEQ ID NO: 128133 - DNA, 69 bp, Homo sapiens; identical to SEQ ID NO: 96084
  chr7:100822573-100822642
  Hyper

SEQ ID NO: 128134 - DNA, 720 bp, Homo sapiens
  chr7:100823050-100823770
  Hyper
gagcgatctgcttggcgggggttcccctgggcgccggaccctggggacaggtgggagcgacatggcaacagaggggggcgggggagcgcttctggacacctgaagcgcagcctctgactcagttttctgggtcttcggactgggaggggctgggcagaagggggcgcagccgcttggtccccctgaggggcggtggccttctgctgccccattctgcggtggaggagcacgctagccccctccccagtccccaggcccggccgcccccctacctcgccggagccggagctggagccagggccgagatgccgcaaagccaagcggggcgggcggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgcgccctgggcagctgggtggcctcaagccctactggcgagactccgccctgtgtcccggctggggagtggg

SEQ ID NO: 128135 - DNA, 273 bp, Homo sapiens
  chr7:100845293-100845566
  Hyper
ctccttggggataggcgggaacagagttcagggctggcgcggtggccaaaggccagtctgggtggccccaacccgggacggggagggagcgggccctgggccaggatcgcggggcggaggccggggctcacctacggtgcggatgggcgcgcggaagggcagcgggaggccccggcggcccaggaacagctgcagggccacgcttagcagcggacgcagagcctcctgcgtcctctgcacccacgagctctgcgggttcgggaactgctggaa

SEQ ID NO: 128136 - DNA, 30 bp, Homo sapiens; identical to SEQ ID NO: 41402
  chr7:100858230-100858260
  Hypo

SEQ ID NO: 128137 - DNA, 39 bp, Homo sapiens; identical to SEQ ID NO: 41403
  chr7:100894771-100894810
  Hypo

SEQ ID NO: 128138 - DNA, 34 bp, Homo sapiens; identical to SEQ ID NO: 41404
  chr7:100897086-100897120
  Hypo

SEQ ID NO: 128139 - DNA, 161 bp, Homo sapiens; identical to SEQ ID NO: 96092
  chr7:100912996-100913157
  Hypo

SEQ ID NO: 128140 - DNA, 358 bp, Homo sapiens; identical to SEQ ID NO: 96093
  chr7:100943169-100943527
  Hyper

SEQ ID NO: 128141 - DNA, 130 bp, Homo sapiens
  chr7:100946544-100946674
  Hyper
gactaataaccccaccgccaccgcgggactcagacgcgaaccaaccgcttgcctgctctaccccgcctgagctttcctggggaccagcccttccctgtccgtcctagccagcgaccgaaccccggggccc

SEQ ID NO: 128142 - DNA, 160 bp, Homo sapiens; identical to SEQ ID NO: 96095
  chr7:100951829-100951989
  Hyper

SEQ ID NO: 128143 - DNA, 30 bp, Homo sapiens; identical to SEQ ID NO: 41405
  chr7:100967105-100967135
  Hypo

SEQ ID NO: 128144 - DNA, 647 bp, Homo sapiens; identical to SEQ ID NO: 96097
  chr7:101005996-101006643
  Hyper

SEQ ID NO: 128145 - DNA, 18 bp, Homo sapiens
  chr7:101056505-101056523
  Hypo
aaagagacttgtggccgg

SEQ ID NO: 128146 - DNA, 24 bp, Homo sapiens
  chr7:101090772-101090796
  Hypo
aacttcctccgttatgatttttgc

SEQ ID NO: 128147 - DNA, 41 bp, Homo sapiens; identical to SEQ ID NO: 96100
  chr7:101116625-101116666
  Hypo

SEQ ID NO: 128148 - DNA, 87 bp, Homo sapiens; identical to SEQ ID NO: 41407
  chr7:101131936-101132023
  Hypo

SEQ ID NO: 128149 - DNA, 38 bp, Homo sapiens; identical to SEQ ID NO: 96102
  chr7:101137675-101137713
  Hypo

SEQ ID NO: 128150 - DNA, 30 bp, Homo sapiens; identical to SEQ ID NO: 96103
  chr7:101151473-101151503
  Hypo

SEQ ID NO: 128151 - DNA, 30 bp, Homo sapiens; identical to SEQ ID NO: 96104
  chr7:101178233-101178263
  Hypo

SEQ ID NO: 128152 - DNA, 230 bp, Homo sapiens; identical to SEQ ID NO: 96105
  chr7:101191125-101191355
  Hypo

SEQ ID NO: 128153 - DNA, 30 bp, Homo sapiens; identical to SEQ ID NO: 96106
  chr7:101206277-101206307
  Hypo

SEQ ID NO: 128154 - DNA, 30 bp, Homo sapiens; identical to SEQ ID NO: 96107
  chr7:101207916-101207946
  Hypo

SEQ ID NO: 128155 - DNA, 333 bp, Homo sapiens; identical to SEQ ID NO: 96108
  chr7:101241831-101242164
  Hypo

SEQ ID NO: 128156 - DNA, 30 bp, Homo sapiens; identical to SEQ ID NO: 96109
  chr7:101262039-101262069
  Hypo

SEQ ID NO: 128157 - DNA, 30 bp, Homo sapiens; identical to SEQ ID NO: 96110
  chr7:101392564-101392594
  Hypo

SEQ ID NO: 128158 - DNA, 68 bp, Homo sapiens; identical to SEQ ID NO: 96111
  chr7:101475790-101475858
  Hypo

SEQ ID NO: 128159 - DNA, 30 bp, Homo sapiens; identical to SEQ ID NO: 96112
  chr7:101480043-101480073
  Hypo

SEQ ID NO: 128160 - DNA, 38 bp, Homo sapiens; identical to SEQ ID NO: 96113
  chr7:101521914-101521952
  Hypo

SEQ ID NO: 128161 - DNA, 149 bp, Homo sapiens; identical to SEQ ID NO: 96114
  chr7:101586167-101586316
  Hypo

SEQ ID NO: 128162 - DNA, 30 bp, Homo sapiens; identical to SEQ ID NO: 96115
  chr7:101596278-101596308
  Hypo

SEQ ID NO: 128163 - DNA, 39 bp, Homo sapiens; identical to SEQ ID NO: 96116
  chr7:101603269-101603308
  Hypo

SEQ ID NO: 128164 - DNA, 89 bp, Homo sapiens; identical to SEQ ID NO: 96117
  chr7:101627757-101627846
  Hypo

SEQ ID NO: 128165 - DNA, 30 bp, Homo sapiens; identical to SEQ ID NO: 96118
  chr7:101628185-101628215
  Hypo

SEQ ID NO: 128166 - DNA, 120 bp, Homo sapiens; identical to SEQ ID NO: 96119
  chr7:101630456-101630576
  Hypo

SEQ ID NO: 128167 - DNA, 115 bp, Homo sapiens; identical to SEQ ID NO: 41412
  chr7:101652590-101652705
  Hypo

SEQ ID NO: 128168 - DNA, 78 bp, Homo sapiens; identical to SEQ ID NO: 15018
  chr7:101656381-101656459
  Hypo

SEQ ID NO: 128169 - DNA, 30 bp, Homo sapiens; identical to SEQ ID NO: 41414
  chr7:101707051-101707081
  Hypo

SEQ ID NO: 128170 - DNA, 102 bp, Homo sapiens; identical to SEQ ID NO: 96123
  chr7:101707433-101707535
  Hypo

SEQ ID NO: 128171 - DNA, 101 bp, Homo sapiens; identical to SEQ ID NO: 96124
  chr7:101707595-101707696
  Hypo

SEQ ID NO: 128172 - DNA, 30 bp, Homo sapiens; identical to SEQ ID NO: 96126
  chr7:102091922-102091952
  Hypo

SEQ ID NO: 128173 - DNA, 97 bp, Homo sapiens; identical to SEQ ID NO: 41417
  chr7:102097002-102097099
  Hypo

SEQ ID NO: 128174 - DNA, 29 bp, Homo sapiens
  chr7:102133076-102133105
  Hypo
acaacctggtaaggtcggatcaacttcct

SEQ ID NO: 128175 - DNA, 29 bp, Homo sapiens
  chr7:102232246-102232275
  Hypo
acaacctggtaaggtcggatcaacttcct

SEQ ID NO: 128176 - DNA, 41 bp, Homo sapiens; identical to SEQ ID NO: 96134
  chr7:102782018-102782059
  Hypo

SEQ ID NO: 128177 - DNA, 40 bp, Homo sapiens; identical to SEQ ID NO: 96135
  chr7:102782119-102782159
  Hypo

SEQ ID NO: 128178 - DNA, 145 bp, Homo sapiens; identical to SEQ ID NO: 96136
  chr7:102921382-102921527
  Hyper

SEQ ID NO: 128179 - DNA, 903 bp, Homo sapiens; identical to SEQ ID NO: 96138
  chr7:103085831-103086734
  Hyper

SEQ ID NO: 128180 - DNA, 86 bp, Homo sapiens; identical to SEQ ID NO: 96140
  chr7:103395555-103395641
  Hypo

SEQ ID NO: 128181 - DNA, 1959 bp, Homo sapiens
  chr7:103629059-103631018
  Hyper
ctggctggtgagcagcgggaactttgcggtcgagcggcgcggggcagccacagacctgggcgcttcaatctgtcaccagcctgcccgcaaagcccagcgacagcccccaacgcccccccggggacccatctggggggaccgggagcaggacaaaggtctgaaatccaagtcctaggagtaaagaaacaaaatgcgcaggttcaatttaaagtgcctgcggtaagtacggggagtgagggggaaagacaccggcctccaagaattctcaggcgtttagcacaagcaccagctcattaccaggagatgcgttcggggagtggggacatggagaatgaatcccaacttgtgactccattctccactaactttattctcgctccctggaccaagcgcatcgctggggccagggttgtcatggttcttgtttccaaggccccttggaagaaggaaagggatgagaaaggtgcgctggcgggcgcacccggcggcggcgagcgcggaggtgctgcggtacctaccatggtattcttgtcccggaacgtagtaggtggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactgcgctccatgccgccgccgccgccgccgccgccgcgcgccctacgcgccgctcgctcattcagttttggagacgccgggacggaggagccacgcggagagaaggcgagaagaaggcggacgggagcggaacgggctcgggagcgggcctgggagcgggcccccgccgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccgccccgctccacaccttcttaaagccccgggcgccgcgtcccccccgccgccgccacacgtgtcccggccgctcccccgcccccgcgcgccgccccgcccgccccccgccctctcgggctggctcggcggcacctcgcgcggcgaggggcgcacgcgtccccggagtccccggccagcgcccggttcgcacccgggaggacagggaggggcgcccgccggggagcgggacggggacgctgtcgaggaccgctgagcccgcgactcttctgcgagggacgtcaaagccccgcagagggcacctcccgtccagctgtctgaaggggaaggccagcccctttggccgtcagtgtgccctgtttttcctgggaggatgcgtgagggaaggagaggggcggcagggacggccgctggcgccggtttctttgtctgagccggctgcgtcccgcgcccctcggggctcgcagtctgccagtccgggcggcccgcactcgttctgggaatccgcccgaggccgcgaaccgctaggggccctcgcgctcccttcccacccaggccccctgtccctcccgccgcggccgcccggcccctcgcggcagcgacagagcctcatctgtagaggattttaaaatgagattaagcgaaagtggaattggcagactcgagtggtgcctggaaatggtgatttgtgctgctcggttgtggggaattgtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 128182 - DNA, 1545 bp, Homo sapiens
  chr7:103968582-103970127
  Hyper
caaagatgcagaggtcgaagcacgtttctgtgcggtgatgaaatgctcgctgaatcagcctctcgagcccggcctctcacacccaccaggatcctggggttgtctctaggatccctgtgggtgctcctgccaccttcttagactaccctcgccctcctaatccaggcccacttctctggctcatgtccaccccttgatgggcgttccggggtcgtcactgtcctctgcgcccctgggcactggcagcgcgggccgggcagcggggagggaggcgggaagcagagcgggaggcgccccgggcttgcgcgccgcggtgctccacgagggatttgccgccttcagctgcagcagctgcagcggcggcggcgggaagaggggtggagggtggtgaggagggccggagcccgggccaggagggagggaggggagccgggaggctgtgccaggcgagccggaggggtgctccgcgctcccccgccctccttccgggagcgaggatgcagactctgaaactggtgctgctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccggtgagtgcgcgctcacctccgcggaggcggaggaccccggggcgcccgagccggggaggggccagagtgggagggacgggggctgtgcgcgccgctgcgagccaagccgcctaatccgctcaggcgtcgaggtgtggggggcgggagcccagcgaggccggaacccccggggttccccagccccggcgctggcgcctcgtcccggggctttcgtgagcctcccaagtgtgggggacgcccactcagagggacgccccggaggcagggcggttgtggggccgagtccgctcagaactaaggatggtgggtggagaagtggccgcttagagagatggggccggggttccgtgctgagggactaaggagggactgacagggcgaagtgaaaagcggatttggagaggtcatagtggaaggagcagccagcctgccctgcccctcgctgctgggactat

SEQ ID NO: 128183 - DNA, 42 bp, Homo sapiens; identical to SEQ ID NO: 96151
  chr7:104628051-104628093
  Hypo

SEQ ID NO: 128184 - DNA, 30 bp, Homo sapiens; identical to SEQ ID NO: 96152
  chr7:105086390-105086420
  Hypo

SEQ ID NO: 128185 - DNA, 79 bp, Homo sapiens; identical to SEQ ID NO: 96153
  chr7:105171453-105171532
  Hypo

SEQ ID NO: 128186 - DNA, 30 bp, Homo sapiens; identical to SEQ ID NO: 96154
  chr7:105220974-105221004
  Hypo

SEQ ID NO: 128187 - DNA, 296 bp, Homo sapiens; identical to SEQ ID NO: 96155
  chr7:105279375-105279671
  Hypo

SEQ ID NO: 128188 - DNA, 30 bp, Homo sapiens; identical to SEQ ID NO: 41420
  chr7:105280417-105280447
  Hypo

SEQ ID NO: 128189 - DNA, 66 bp, Homo sapiens; identical to SEQ ID NO: 96157
  chr7:105288157-105288223
  Hypo

SEQ ID NO: 128190 - DNA, 30 bp, Homo sapiens; identical to SEQ ID NO: 96158
  chr7:105331896-105331926
  Hyper

SEQ ID NO: 128191 - DNA, 30 bp, Homo sapiens; identical to SEQ ID NO: 96159
  chr7:105432522-105432552
  Hypo

SEQ ID NO: 128192 - DNA, 115 bp, Homo sapiens; identical to SEQ ID NO: 96161
  chr7:105649670-105649785
  Hypo

SEQ ID NO: 128193 - DNA, 30 bp, Homo sapiens; identical to SEQ ID NO: 96162
  chr7:105753818-105753848
  Hypo

SEQ ID NO: 128194 - DNA, 35 bp, Homo sapiens; identical to SEQ ID NO: 96163
  chr7:106123211-106123246
  Hypo

SEQ ID NO: 128195 - DNA, 95 bp, Homo sapiens; identical to SEQ ID NO: 96164
  chr7:106123306-106123401
  Hypo

SEQ ID NO: 128196 - DNA, 126 bp, Homo sapiens; identical to SEQ ID NO: 96165
  chr7:106507970-106508096
  Hypo

SEQ ID NO: 128197 - DNA, 290 bp, Homo sapiens; identical to SEQ ID NO: 41424
  chr7:106508656-106508946
  Hypo

SEQ ID NO: 128198 - DNA, 39 bp, Homo sapiens; identical to SEQ ID NO: 96168
  chr7:106609350-106609389
  Hypo

SEQ ID NO: 128199 - DNA, 22 bp, Homo sapiens
  chr7:106636238-106636260
  Hypo
aaaaacccgtgtattttacttt

SEQ ID NO: 128200 - DNA, 30 bp, Homo sapiens; identical to SEQ ID NO: 96170
  chr7:106637063-106637093
  Hypo

SEQ ID NO: 128201 - DNA, 30 bp, Homo sapiens; identical to SEQ ID NO: 96171
  chr7:106644946-106644976
  Hypo

SEQ ID NO: 128202 - DNA, 79 bp, Homo sapiens; identical to SEQ ID NO: 96172
  chr7:106651422-106651501
  Hypo

SEQ ID NO: 128203 - DNA, 18 bp, Homo sapiens
  chr7:106653764-106653782
  Hypo
aaaggctggtcatggcgg

SEQ ID NO: 128204 - DNA, 88 bp, Homo sapiens; identical to SEQ ID NO: 96174
  chr7:106684832-106684920
  Hyper

SEQ ID NO: 128205 - DNA, 749 bp, Homo sapiens; identical to SEQ ID NO: 96175
  chr7:106685171-106685920
  Hyper

SEQ ID NO: 128206 - DNA, 103 bp, Homo sapiens; identical to SEQ ID NO: 96176
  chr7:106712145-106712248
  Hypo

SEQ ID NO: 128207 - DNA, 16 bp, Homo sapiens
  chr7:106748394-106748410
  Hypo
ccggccaagagatgtt

SEQ ID NO: 128208 - DNA, 20 bp, Homo sapiens
  chr7:106796956-106796976
  Hypo
ctcttcatttagggccgggc

SEQ ID NO: 128209 - DNA, 20 bp, Homo sapiens
  chr7:106797276-106797296
  Hypo
gaaaccgagacagcttgttc

SEQ ID NO: 128210 - DNA, 105 bp, Homo sapiens; identical to SEQ ID NO: 96180
  chr7:106797653-106797758
  Hypo

SEQ ID NO: 128211 - DNA, 90 bp, Homo sapiens; identical to SEQ ID NO: 96181
  chr7:106802877-106802967
  Hypo

SEQ ID NO: 128212 - DNA, 178 bp, Homo sapiens; identical to SEQ ID NO: 96182
  chr7:106837489-106837667
  Hypo

SEQ ID NO: 128213 - DNA, 30 bp, Homo sapiens; identical to SEQ ID NO: 96183
  chr7:107060805-107060835
  Hypo

SEQ ID NO: 128214 - DNA, 100 bp, Homo sapiens; identical to SEQ ID NO: 96184
  chr7:107148303-107148403
  Hypo

SEQ ID NO: 128215 - DNA, 1363 bp, Homo sapiens; identical to SEQ ID NO: 96186
  chr7:107300982-107302345
  Hyper

SEQ ID NO: 128216 - DNA, 224 bp, Homo sapiens; identical to SEQ ID NO: 96188
  chr7:107483694-107483918
  Hypo

SEQ ID NO: 128217 - DNA, 89 bp, Homo sapiens; identical to SEQ ID NO: 96189
  chr7:107642639-107642728
  Hyper

SEQ ID NO: 128218 - DNA, 113 bp, Homo sapiens; identical to SEQ ID NO: 96190
  chr7:107643070-107643183
  Hyper

SEQ ID NO: 128219 - DNA, 273 bp, Homo sapiens; identical to SEQ ID NO: 96191
  chr7:107643722-107643995
  Hyper

SEQ ID NO: 128220 - DNA, 2439 bp, Homo sapiens
  chr7:108095272-108097711
  Hyper
acccgcacttctgagcgttaaccatctgggactcggaaaggaaaagaaagctttcttctcaggacagttctgcgccggtggtagccaagggctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcagcgcttgcggccctgaggacaccgctttgggagaaatgacgactcccttgctcaccctactgcgacaccccgtccccctccgcactctagcagatgcgggccgggagtagctgagctggccaaccgcctgggaccaggatgcggcagcgcccacccgcgcggcgtggagggggccgggggcggcgctcggcgcagatggcgctcgctgcgagatggatgctccagggcgggtaatcactcctggctcaacacagcatcccgggcggagcggatgccagatcccaccgctaagagcctgggctgggaaagcaatctttccaggcagcccccagcccggtgcgccggccccgacaagtcccagccctcggaggcagggcggggcgcagggactcccgggacccgcacctgtaaggccgacaaagcccccgcaagcgccccacccctctgtcctccgtgtctctctcgttccgcctcgattccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgcgccggcgcgcgcccccgccgctcccgccctctccgctccccctccccgcgccgtgcttttgcccctcccggctctccttagcgtcctcccgtccccctcccccgcactccctgcgggcgtcctccgcctcctcccctcctggccaaccccctcttgccctgctgctgcgacggcagcgaatgggctccagccgccggcgcctcgagggactgggtggcccctcacctgagcggccgccccaccgccaacctccgtcagcctgcgagcgcgtgtggcggcgggggtgggggtgcggggacggagggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatccgcggtagaaactgggtcttctggtcccaaggaatagggttagttcggatttgcttatttacaaatgggggagtattatggagattttttttttttttttttggcaatgtaaatcgagaattaagattttccaactgtatagtatttgagtaaacacactgcttgctgcatagttcaggctccgaagcgcacgtctccactctatcgtggatggtgttca

SEQ ID NO: 128221 - DNA, 42 bp, Homo sapiens; identical to SEQ ID NO: 96194
  chr7:108164980-108165022
  Hypo

SEQ ID NO: 128222 - DNA, 41 bp, Homo sapiens; identical to SEQ ID NO: 96195
  chr7:108165202-108165243
  Hypo

SEQ ID NO: 128223 - DNA, 30 bp, Homo sapiens; identical to SEQ ID NO: 96196
  chr7:108168666-108168696
  Hypo

SEQ ID NO: 128224 - DNA, 187 bp, Homo sapiens; identical to SEQ ID NO: 96198
  chr7:108503958-108504145
  Hypo

SEQ ID NO: 128225 - DNA, 150 bp, Homo sapiens; identical to SEQ ID NO: 41434
  chr7:108515007-108515157
  Hypo

SEQ ID NO: 128226 - DNA, 39 bp, Homo sapiens; identical to SEQ ID NO: 96203
  chr7:111560077-111560116
  Hypo

SEQ ID NO: 128227 - DNA, 98 bp, Homo sapiens; identical to SEQ ID NO: 96204
  chr7:111560176-111560274
  Hypo

SEQ ID NO: 128228 - DNA, 30 bp, Homo sapiens; identical to SEQ ID NO: 41435
  chr7:111662581-111662611
  Hypo

SEQ ID NO: 128229 - DNA, 80 bp, Homo sapiens; identical to SEQ ID NO: 96207
  chr7:111844185-111844265
  Hyper

SEQ ID NO: 128230 - DNA, 30 bp, Homo sapiens; identical to SEQ ID NO: 96208
  chr7:112220127-112220157
  Hypo

SEQ ID NO: 128231 - DNA, 30 bp, Homo sapiens; identical to SEQ ID NO: 96209
  chr7:112429052-112429082
  Hypo

SEQ ID NO: 128232 - DNA, 156 bp, Homo sapiens; identical to SEQ ID NO: 96210
  chr7:112431236-112431392
  Hypo

SEQ ID NO: 128233 - DNA, 27 bp, Homo sapiens
  chr7:112726381-112726408
  Hyper
ggtgttggatatcccgacagactatag

SEQ ID NO: 128234 - DNA, 86 bp, Homo sapiens
  chr7:112726528-112726614
  Hyper
agggctcggcggcgcctgcgcgctggagcctccttgagctccagccgcgtcctcccctgtcgcagcggcaccgtctcccccagtaa

SEQ ID NO: 128235 - DNA, 141 bp, Homo sapiens; identical to SEQ ID NO: 96213
  chr7:112726853-112726994
  Hyper

SEQ ID NO: 128236 - DNA, 1087 bp, Homo sapiens
  chr7:113722696-113723783
  Hyper
ttctaatttgtcattcgcgtgcgtcgctttccttcatcttggctatacttcctctcatctgcggtgttttatttcgcgcaagatgcgctgacagaggccatttcaaacgaatttatctttcactaggaccgtactagagcagtgtctcgaattttgttgatttgtggtttcgtcgtaaaataaacttgaaatcaaataaactttcgtgaggaagctttgatgtccacttggtgaaactcctcattcacccagttgagccgttgaactttcttctggaacctctttaaatgacttttgccgatccacgtgctgcaaagaagacctgaaccgtgcctatgaccctgcgcggcgactacagggacagaatttggctttccttctctttccaatatgcagcgtttcgtttaaaggctgcctcgatccagtgggctgaccagtgacttgtgcaaaagaaaactattcgatcgctgtttgccctttcagcgttttcctcggctgcggaaacccggttttcctattattatacttcaactttttttggagtcagctagcacagagcgctaaaccccggccagttccagcagcagccgaggcgaacaaagcctgcagtgttcggggccatgctggggcgggagtggtggacgagttcaaggaattgcaaataaatatattttatgaccacccatcaacaaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacaggacctgttttcccaactccctggacagcttccctgcgggatgggttggtggcccggggcatggcagcaggcgaggaggagataatgggggcgaagttgagcgggggcacttgggagctgcgggctcagtttcactgagaaaaaggccccggaagggtacgcgtccactctataaatatatactcctccgactgagatgtcct

SEQ ID NO: 128237 - DNA, 726 bp, Homo sapiens; identical to SEQ ID NO: 96216
  chr7:113724746-113725472
  Hyper

SEQ ID NO: 128238 - DNA, 157 bp, Homo sapiens; identical to SEQ ID NO: 96217
  chr7:113725701-113725858
  Hyper

SEQ ID NO: 128239 - DNA, 800 bp, Homo sapiens; identical to SEQ ID NO: 96218
  chr7:113726087-113726887
  Hyper

SEQ ID NO: 128240 - DNA, 439 bp, Homo sapiens
  chr7:113727369-113727808
  Hyper
gactgctgccttgatcgcgttcctttccctgtccacgcgttagcacgaccggcttcccccggtgtctggcctggttttacttttattccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcgggcgggcagagcgcgggtccgaacgcccttcgcgctcgcggcggcgcacgtgcggcggcggcggcggcgccggcggcgcgggcgggacccactgggtggccgcgcgcgccacccgcgcgttttctgcgcgcctctgcccacccgcgaggccgcaacgcgccctgacacccgacctcagtgtgga

SEQ ID NO: 128241 - DNA, 1359 bp, Homo sapiens
  chr7:114562155-114563514
  Hyper
cccctttcccagccccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccactcccccttcctttggttgcgaagaaacaggatgacaggattgcttctttcttaagcatatgcatgtttgggcctaagactcaatgtgtaggttctgaagcgcttctcctctagg

SEQ ID NO: 128242 - DNA, 475 bp, Homo sapiens; identical to SEQ ID NO: 96225
  chr7:115117435-115117910
  Hyper

SEQ ID NO: 128243 - DNA, 43 bp, Homo sapiens; identical to SEQ ID NO: 96226
  chr7:115738426-115738469
  Hypo

SEQ ID NO: 128244 - DNA, 327 bp, Homo sapiens
  chr7:116139864-116140191
  Hyper
acagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgctaccgggtcggccccgcagggtctgagacccgcacccttccccggtcccacccgtcaccaggccgcccgcgtagccaggaattcttagccaggttcctgtgcgcccaccgtgaccc

SEQ ID NO: 128245 - DNA, 30 bp, Homo sapiens; identical to SEQ ID NO: 96229
  chr7:116166712-116166742
  Hyper

SEQ ID NO: 128246 - DNA, 92 bp, Homo sapiens; identical to SEQ ID NO: 96230
  chr7:116339527-116339619
  Hypo

SEQ ID NO: 128247 - DNA, 44 bp, Homo sapiens; identical to SEQ ID NO: 96231
  chr7:116492603-116492647
  Hypo

SEQ ID NO: 128248 - DNA, 30 bp, Homo sapiens; identical to SEQ ID NO: 96232
  chr7:116620287-116620317
  Hypo

SEQ ID NO: 128249 - DNA, 30 bp, Homo sapiens; identical to SEQ ID NO: 96233
  chr7:116921667-116921697
  Hypo

SEQ ID NO: 128250 - DNA, 2338 bp, Homo sapiens
  chr7:116962402-116964740
  Hyper
agcaaaatgttcttccgccccactggggtgaacctggaatgtggaaggacgggaaataatacaaagtcacacgctttaggttctacaactcctgactggctgaattggcccgtcgatttaccttgaggcagttttggcggggtgggggctgggatgggggaggcggttgtagttttcaaggtgaatttacacacacacacacacacacacacacacacacacacgtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccggcgcctcgccgcgcccccgccccccgctcgcgtctgcgacgagtggcgagactcgctgataaagtttcaaacgatgggcccagcgagcgataaaggccagcccggaccgcctcgcccacagcccaattccccaggcgcagcgagcgcctgcagcccgaaagctctgcgcgcctcccgcgcgccccgtccgctctgctcccctccgggcgcagccgagggagggggtgctgcgcctggcgggggtggggagaaacgcggggttttagacacgggtgcatgaaatgatggcaagagatgtctggggatgaggtgaggcggggaagggggaacatcgctgcatggttacgagcacacgcgaatacaggaacctttagggaagctccaggccaaagagcatccgtgggctctcggagcgtgcgttccggattgccgaggccatccgctggcaaacaagtccctgagcgtgcaatgtgaggaaacgaggaagggggccaggggataaggagattactatgcatgggatacaagaatccagagatgattctcaactcattgcttcgcttctctccctgaagctgggatgaagagctagcacttgtaaatttggagctgccgcgtctatgcagggcaaggttagggaggggccaggcctctgcgaaatgacctgttggctttgattccttggtgctgggcttaaatacagagcccatagggaggggaacttggagggtccatgaccctcgggacctaacccagcagtatctgccaaagcacccaggaaagatgcagtttttacgcacacccagctcctctccggagctgcggagcgcaaaagatcacatagagaggaaccgaggcagccaggcgttcgccgggggtgtgcgcccttgcacctcctgccgcctgggcgctcagcctgtgcgccttgtggaggttaagggaccctcggtcctggacctgggcccccgcccagccaagagagaggggcttgggcccgcgggtggagcattttgagcagtagctggcttgtagccgcgccgtttatcaccggaaaggaaggaagaccaggaactcgtggcggccgtgaactgttccattgctcttttcctggggcggagggactcactgcccgcccgaggagcgtgctctggggaatagagtatgcgcctgtgtgtatgtgtgggaggcgaattgttcgcagggcgtgggggagggggtgccgcccagatcggaaggacgggctctccctctctccagcccaccctcgggcctggactggccagagcgtcagccctcgccggcagcgagcgcggtgagaggctggacgaggcgaagctcagagacgccaaaaacctgaaagatgctgtcatcgccacccccttcccccacgctggtccctggcaggtccggcccctcccaggctgacccagatacatccccgtttgggtccggaaagggaggggagggaaacaagcaccgcgccacccacgactcgggaagagcagggctcctcgccagggccgctccgtatcgctgggccgcgacccagggaagttctgcttggtctgcgtcggtcgggcgggaggtgcaggga

SEQ ID NO: 128251 - DNA, 876 bp, Homo sapiens; identical to SEQ ID NO: 96236
  chr7:117119448-117120324
  Hyper

SEQ ID NO: 128252 - DNA, 30 bp, Homo sapiens; identical to SEQ ID NO: 96237
  chr7:117433609-117433639
  Hypo

SEQ ID NO: 128253 - DNA, 104 bp, Homo sapiens; identical to SEQ ID NO: 96238
  chr7:117512306-117512410
  Hyper

SEQ ID NO: 128254 - DNA, 391 bp, Homo sapiens; identical to SEQ ID NO: 96239
  chr7:117512787-117513178
  Hyper

SEQ ID NO: 128255 - DNA, 35 bp, Homo sapiens; identical to SEQ ID NO: 31483
  chr7:117513436-117513471
  Hyper

SEQ ID NO: 128256 - DNA, 30 bp, Homo sapiens; identical to SEQ ID NO: 96241
  chr7:117805645-117805675
  Hypo

SEQ ID NO: 128257 - DNA, 778 bp, Homo sapiens
  chr7:119912968-119913746
  Hyper
ccttgaaccgggactcgagaggcagaagcaaggcacgggtcccctttctcctctcctccaccaaaccaccgcagcccagcacgtgaagcttccctttgttcatccgaggctcgcttttctccccagcagatccacctggatgctctccctcggtgacattttgcgccggggttggtgggtggctggggtggagcgagaggagcccgagggggcgggggcggagaaaggtcaagccgagggaaaggcaggagacgcctttcctaacctgcgtggcggggcgtgcgcgcggttatttatttattttctccttatttattgatcgcactagcagagcagcgcggggagcccggggagatgcaggaccacccactggcggggaagcagctagcagccctcccgcgcccccgcgctgccgagcgccttctgcctccgcgctcggacgagagcccgtgccggccccggccccggccccaccgcgccaacgccgcccgcccggccgccccgcagccccgccgccccgcagccccgcaccgcgctggccaggctcccgcgacagtggccccgcagtaagttggcaggagcgagtcccctccgttctcgcctcccccgcaccttttgaacttgttgctgctgctctgctcgcctgcgcctggcttttggaaggtgaaaaggaggagggaggcacggagggatgggggaagggaaagaagagctcgcttgagctttatttatgctctctcggcgcatcggattcggctgctcgcgagctgctttctct

SEQ ID NO: 128258 - DNA, 106 bp, Homo sapiens; identical to SEQ ID NO: 96245
  chr7:119913981-119914087
  Hyper

SEQ ID NO: 128259 - DNA, 33 bp, Homo sapiens; identical to SEQ ID NO: 96246
  chr7:120368239-120368272
  Hypo

SEQ ID NO: 128260 - DNA, 93 bp, Homo sapiens; identical to SEQ ID NO: 96247
  chr7:120969260-120969353
  Hyper

SEQ ID NO: 128261 - DNA, 1092 bp, Homo sapiens
  chr7:120969626-120970718
  Hyper
gggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggtgagtcctgggtccttaggggttggtgggggacggaaggcgacaactcctccaccggttcctgcaaataaagtaaatagtgctacgtggtcctgtagctctctaagttccagaagaagccctttagtgcacggggattgagagctacaaaggccagacctggggagcaggtgcgagcctggagggaggtgactccccagttccagagcggagctctaggggctggagctcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgagccgcgcacctcccccgcg

SEQ ID NO: 128262 - DNA, 149 bp, Homo sapiens; identical to SEQ ID NO: 96252
  chr7:121512756-121512905
  Hyper

SEQ ID NO: 128263 - DNA, 405 bp, Homo sapiens; identical to SEQ ID NO: 96253
  chr7:121513553-121513958
  Hyper

SEQ ID NO: 128264 - DNA, 774 bp, Homo sapiens; identical to SEQ ID NO: 96255
  chr7:121783508-121784282
  Hyper

SEQ ID NO: 128265 - DNA, 138 bp, Homo sapiens; identical to SEQ ID NO: 96256
  chr7:121784548-121784686
  Hyper

SEQ ID NO: 128266 - DNA, 1413 bp, Homo sapiens
  chr7:121939677-121941090
  Hyper
ggagctacttagggccgcatagattcggaatccagccaactatggaattccaagaccctcgctccctcgctttccgaagtcaaatctaacatggatttggccccaacagtgggcaaggtcggggcatgaggtcaggaaaggagaaacatcggttttcgatctaataatggctgggctggagcttgttccctgtgtccaaagggcgtgcgtactagcacaagcgttgagaaaggtctggacccgatgtctgcaggaagtgtcaggacctccctgttctggggaccttcccagcccacaccaggtccgtgctctctagattcccccaacctcgctccacaacccggaaggagctcaggccggacttggcgtgagggtccctgcggggctgggtcacctacccgtccgcgatcaccccacaggggctgttagtaatctccctgcttcctaggccgttgagaagcactcaggtcacccactctcggtgaccagagcggtcagtctttccccgccatgaaatgtgagttcgggtggcagccgccgcgcccctgcagtgtcccctgcacatctccggtctcggtctcgcctttctcagctccgcgccgccttttcctgggcgccgcaggactcatagaagtgaggcggggccacagatttaagtttattccccgcaactgtcggggcggtcccggagctggtgaggacgcgctacggtgggtgcagaaaggagatccctggactctgtagaacctgggcccgcggtgtggaccgatggtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatgtggccccgctgcagtagcactacggtgctgggctgtttgtctggcagcttctactgagcagctaatagtataacaacccggctttgataaatctgaactaattacccctcttaattaaagtctttagcagttgtttcattgttttggcaagaaaacaggagagacgtgcagttagaaacaccagagcccgagctcacagcggagccgctgattaacacttgaagcatttcaaggacctggcacccgccacagtttggttttcatccatgtttcctccttgaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgtacattgcatacagctactggatacgttgttcccattta

SEQ ID NO: 128267 - DNA, 510 bp, Homo sapiens; identical to SEQ ID NO: 96259
  chr7:121941881-121942391
  Hyper

SEQ ID NO: 128268 - DNA, 736 bp, Homo sapiens
  chr7:121943656-121944392
  Hyper
gaaggaaaggatctccgttttgcattgtacttgcctttccacacacttcgcaagtgaaaactttgggcttggcattaggagagcctcggctgaaatccgaggttttgaacgcgattttttccgacagaagctgggcgctttctttcatgtaatgctgcagctgagcctgggacaggtctttgaaagctactccagaagggtatttctccaccgccgggaccaccagtttattcctttcggctaaatacgtttttggctgcgggtgcaaaggggaactgaggaagtaggaggccaccgggtggatgttcacgccggctgccgggtggcatgggccgtcacctcggttcaggtagcacaaggcgcccatggcgtggaatgaagagtggttgaccacacgcggccttaccagcttgtactgctgcagcggcagcgcgtcgcgggccaggtcgcccttgagactcagtgcgcagttgagcaggtcgctgcagctgaatgcgggagccgagggcaccgccgcgggcgccgccggggcctccagactggccttccgcggctcggagcccgtcactcctgccttggggctcgtgtcgtaggccacaggcacgaaggggatcatgcaggggatcgacgagttgagatgcagagagtgcttgggttcccccttgggtaaggctccctgcaggaagtgggggactggcagggccttgggctctggggtgcgcgccatgattcgttc

SEQ ID NO: 128269 - DNA, 30 bp, Homo sapiens; identical to SEQ ID NO: 31498
  chr7:121944621-121944651
  Hyper

SEQ ID NO: 128270 - DNA, 535 bp, Homo sapiens; identical to SEQ ID NO: 96263
  chr7:121945611-121946146
  Hyper

SEQ ID NO: 128271 - DNA, 1077 bp, Homo sapiens
  chr7:121946372-121947449
  Hyper
caagtgtagtgggggcgtccttctgctagagctctgaaaagggttggccccggaaggctggataacggcggactagaaaccctggcattattaagtccctgagcaatttcactcaaagatgcgaaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcccgggtgcacctactttggattcgcccagactgcaaatttttctttccttttgctggggccacgggacagagcacctgggcagagcaagcggagaggcgccacatccccgagaggcgcttcgtagttgtccttggaccgggcgcagacactcagtattggtcagcgctggaaattttctttccttttgctgttggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaaggaaaaagccaagaagcgcgaagcagcccggctctggaaggct

SEQ ID NO: 128272 - DNA, 902 bp, Homo sapiens
  chr7:121950038-121950940
  Hyper
ccttgacactacccacgaagtttaaagcattttttatgttattttcaaactttcttaagtgatcccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactccggcccgggagtgccccgcgccgacccgctggccttggccgtctcagccttcattatcgccacggccttggcgccccctgcccccggctgcccaggggaaccaagttcccgctgctggagttggggcagaggagccccgcctcattcaggattcggtggccagcgcagagccatttgaatagaagaagcccgaagtgaaacagaaaagctgaaaactccccggctgggctctccacttctcggttcttgctcacgagttccaaacagttaaagtgacgttggcaaggccgagggccaccgagctctgtgagactcccttggaggggtcaggaaacttagctcgagaagcttggaggcggctgggagttggggcgcaacttcagtgaccgggcgccgctgccgggctggggctcccaagcgtccggctcccggggtggtcgacgcggcgctgccttcgatcaggtcccgccgacctcgggcctctggaccaccaccgccccagctggtctggcaacccatcccgggcgcaatcgcgctcctccccttctcctctgcattcccgcaggtcctggggcggctccatccccccaaggctgagagatggcgagggaggctccaaagagtttcgggagggggcgccggatctggtttaagagaccgcggaacagatggtgg

SEQ ID NO: 128273 - DNA, 306 bp, Homo sapiens
  chr7:121951863-121952169
  Hyper
ggctcctggaaacaacgcgaagctttaagcgccccgcgcgggtgttgacgctggcagctcgcaaacagcgtcccgcggccacggtgacccgaggggccggccggctgacgtcacgaacgcggccagctgcggggacccgggctgcaaccgcggcctctggcccctgccttctcgttgggtcgagggtgggaagggaagttgaggtctggggtaaaaagccggaaaaagaaaggaacaaggctgagaatcattcaaagattaaatggggtcggctcccgttgcttgcgaagacggatgaggagggag

SEQ ID NO: 128274 - DNA, 45 bp, Homo sapiens; identical to SEQ ID NO: 96270
  chr7:121955270-121955315
  Hyper

SEQ ID NO: 128275 - DNA, 465 bp, Homo sapiens; identical to SEQ ID NO: 96271
  chr7:121955375-121955840
  Hyper

SEQ ID NO: 128276 - DNA, 78 bp, Homo sapiens; identical to SEQ ID NO: 96272
  chr7:121956177-121956255
  Hyper

SEQ ID NO: 128277 - DNA, 873 bp, Homo sapiens
  chr7:121956458-121957331
  Hyper
tccccatcttcaatccgaagctggggtatcccagagaaagtctcgctctgagctcctgctggggcacctgcccagccatgcccctcgagggcgtcgctgctctcaacccctctccgctactgcccggccgcccaggcctgtggacgcgactccatctgtagcaaagttcgggggccaaatgggtcgcggctcttcctcgaaggttactgcgagcgggacttgaagggaaaaggaggcgcattagcgacttcgttttcttgcatagtactggtacagagtaccggtgatggtcgtaggggaactctatgtaaagactggatgaccaccggcctcccggaaaccccacacgccaggcctccaacttcttcacaaaagtggggtgggtggcggagggctgtggcgggggcttggagctgctgagagccgagaggcgcagagcgcaagctggcaggctgggctgctatcccggcgcgcagatgccccgccgccagtcgagcgcgaacatctctccggaacatcgatctatcacctccctttaaggacccggaccgggaaatttccattttctgttttgggaataagaaataaaagcgaccaagctcttgccctaatttccccccgcgggcccttccacgcgggctggcgggatcagaaggacgggtccgagctcgggggcgcggggttcctgtgaactccgggcttgctcggtccggtccccgcgcctgctgtccccaggccctctcgggaggcagaccgcggcagcgcaaaggggcttcgaggatctctgagcaacgacggctgagtgacctctttccctctcaagcacaccttcaaggagccggtggaccctctcaccgccggtagctgcaggct

SEQ ID NO: 128278 - DNA, 314 bp, Homo sapiens; identical to SEQ ID NO: 96279
  chr7:123172930-123173244
  Hyper

SEQ ID NO: 128279 - DNA, 16 bp, Homo sapiens
  chr7:123175665-123175681
  Hypo
agagtcttgctctgtc

SEQ ID NO: 128280 - DNA, 30 bp, Homo sapiens; identical to SEQ ID NO: 96281
  chr7:123259499-123259529
  Hypo

SEQ ID NO: 128281 - DNA, 1007 bp, Homo sapiens; identical to SEQ ID NO: 96282
  chr7:123672016-123673023
  Hyper

SEQ ID NO: 128282 - DNA, 157 bp, Homo sapiens; identical to SEQ ID NO: 31517
  chr7:123673226-123673383
  Hyper

SEQ ID NO: 128283 - DNA, 856 bp, Homo sapiens
  chr7:124404361-124405217
  Hyper
tccattctgggccagcgcccggcccgggagtgcaattgtccacccttcgtgccccgccagtccattggccgtcttggacaggggcttgtggtgggaaccctggagtttcccggctctccttggccagtaaaaaagatcgctggctccggggactgtcttcacactctgctcctggctacgcccggaaatgccagcgcctctgggacccttctcttcctcctctgagatctgaaggaagagctggagggccgtggggttccctctccccaaagtttcagaaggctcctgaccccgagcacctttccacctccaggggccaggtggcctggttggaggtcccgggggtccggctgccgacgcctccgcccctctgcctgcagccgggtcacggcccggggccgccggcaggtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagaggcagacaccttgagcagtagcagaagcagtagccgcgacatgcgggcgagaagcgcgcccggggctcgcatggcttggtgagggcacacccggcagccgcagctcctgcttagttaggatcgacacctgctgccgaagttgctgctgagagttaggcacatgtcacatactcacccccgcccgggtagcggggaaccggagattagggtgatagcggaagatcggtcttgggggtcacacacacgccccctataatcc

SEQ ID NO: 128284 - DNA, 671 bp, Homo sapiens; identical to SEQ ID NO: 31521
  chr7:124405556-124406227
  Hyper

SEQ ID NO: 128285 - DNA, 35 bp, Homo sapiens; identical to SEQ ID NO: 96292
  chr7:126325948-126325983
  Hypo

SEQ ID NO: 128286 - DNA, 2032 bp, Homo sapiens; identical to SEQ ID NO: 96295
  chr7:126891206-126893238
  Hyper

SEQ ID NO: 128287 - DNA, 47 bp, Homo sapiens; identical to SEQ ID NO: 96296
  chr7:126893442-126893489
  Hyper

SEQ ID NO: 128288 - DNA, 214 bp, Homo sapiens
  chr7:126987739-126987953
  Hyper
ggctcaaaccagggacggcgagggcaaggggtgaaaggggtttgaggcgaggcagaggactcaggggtctgcggacggctggtcggcccgtggagacggccgcggcgaggcgcctgaggtacggcggtgcggagcgagggcgaggtcccgccggcggccaggcggcggcgctcacggagccgcgggcttccccaggccccgggcagcgtgctgg

SEQ ID NO: 128289 - DNA, 49 bp, Homo sapiens; identical to SEQ ID NO: 96300
  chr7:126988157-126988206
  Hyper

SEQ ID NO: 128290 - DNA, 206 bp, Homo sapiens; identical to SEQ ID NO: 96302
  chr7:127061193-127061399
  Hypo

SEQ ID NO: 128291 - DNA, 100 bp, Homo sapiens; identical to SEQ ID NO: 96306
  chr7:127253534-127253634
  Hypo

SEQ ID NO: 128292 - DNA, 181 bp, Homo sapiens; identical to SEQ ID NO: 96307
  chr7:127260532-127260713
  Hyper

SEQ ID NO: 128293 - DNA, 30 bp, Homo sapiens; identical to SEQ ID NO: 41439
  chr7:127371129-127371159
  Hypo

SEQ ID NO: 128294 - DNA, 30 bp, Homo sapiens; identical to SEQ ID NO: 96316
  chr7:127615921-127615951
  Hypo

SEQ ID NO: 128295 - DNA, 653 bp, Homo sapiens
  chr7:127744057-127744710
  Hyper
atgaagaaactgagccgaggaaaggaagcgacttggccaaggtcggagagctcattctttgcagggcggggtttggaacccggggtctggctctcggcaacgcgccctcggcccgcagcctcctgccccctgtgccccgcttcggcccccagcgcagctgcagaggggcccccctcgacgcatacactcaagagcccgaccgcgcggctgaaatcgcggagctcggagccgcggctggctgagcgatcgcggttcctgggctgcgtgcgcgccccttggagctgaaaggagcgccaggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctccttgttcctctaccagtccctccctccgcaggtctctgggg

SEQ ID NO: 128296 - DNA, 141 bp, Homo sapiens; identical to SEQ ID NO: 96322
  chr7:127776269-127776410
  Hyper

SEQ ID NO: 128297 - DNA, 897 bp, Homo sapiens; identical to SEQ ID NO: 96324
  chr7:127806266-127807163
  Hyper

SEQ ID NO: 128298 - DNA, 1247 bp, Homo sapiens; identical to SEQ ID NO: 96325
  chr7:127807478-127808725
  Hyper

SEQ ID NO: 128299 - DNA, 648 bp, Homo sapiens
  chr7:127841202-127841850
  Hyper
tttacagttaaaaggcgttagcgctggcctttgagacagactcactgagccacccaaggtcacccgggcagcgggcacagttgggactgaacgcaggggctctacctgtgccaggtgtccacacctcggtggcgctcggccgcctgacctcctcttggagttcccggctcagggcagggggtcgcgtccctgcggtctctggaggccacgccccacccgggcccaccggggtgggcgtggctacgtggctccctggcgctgaggcgcctccttcccaggtgggcggggctcctgccgggtcggttcccgcaggctgcccgcggaccccagccacttggccaggctgcagggacagtgcgaggaggcgctcagcctggaccacagcggaggtgtgcaggactcagcgaggcccccaagcttgtacgcctccttcctccgccggcttctctgtctgcctcccactgtccctattctgcccttcacagatcgttgtcattatcaagtcctacactttgagagcagaaaacgaccccgtacgtggtgggtctccgacatctgtttattacgttggaccgcatgctgcatatgatccagccacctcgctctactcctgtggctgcccttcgtcctcgtcgccgggacccctct

SEQ ID NO: 128300 - DNA, 30 bp, Homo sapiens; identical to SEQ ID NO: 96331
  chr7:127982386-127982416
  Hypo

SEQ ID NO: 128301 - DNA, 890 bp, Homo sapiens
  chr7:127991661-127992551
  Hyper
gcagcagcggagccgcgtggcccggggacaagcggaagagcttggcccagcagcgcggcggcacgcgaggactgcagagcgccgggtagaggcccagcagcgccaacgggagcgcgacgcccacctcgcccaggcgcaggcctagctggaaggcccaccagggccagggcccttccaggccggattggccgccgtagcccagggcgtgcagcacctcatagccctgcagggctccgctcagcagcccgaaggtgcccgccaccggggccgtgcgcgccgcgcgccgccaggactcccgaggggcgaaggggctgcgcccctgcggcaggggtgtggcgcccttgaagcccgaccctcccaggggcgccccggcccgccgccgccgcccgccccagcaggagagcgccagcagcagcccggaaaggaaagcggcgagaaaggcgtgcagcccgcgcgaggcgagccgcaggggccgcagcgggcgatgcgcggcgctcccgagggcggcggcggccgccagccccagccccaggagcagcagcgcagccaggccggtggggcaccgcggcgggcgcggccgggccagcagcaggcaggccagccccaggccggcagccaagcagggcagcggaaggtcctgcagcagcagccaggcgagcgcgggcagtcgatccctgtgcccataggcgtcgtagaagagcgggaaggcccgcgtggtcccggccgacagcagcagcaggtccagcagcgccaggcagggggcgccgggcgggcaccgccagggcaagagggccagagccagcagcgccagcaaggcaaccaggccgaagagcgcgcctaccccgtacacgtgggcctcccaggccagcccccagcgagccctggcctct

SEQ ID NO: 128302 - DNA, 49 bp, Homo sapiens
  chr7:128000972-128001021
  Hyper
catagccacatctagcgcccgtgacacactcacccgtcacatacccccc

SEQ ID NO: 128303 - DNA, 157 bp, Homo sapiens; identical to SEQ ID NO: 96338
  chr7:128002255-128002412
  Hyper

SEQ ID NO: 128304 - DNA, 102 bp, Homo sapiens; identical to SEQ ID NO: 41440
  chr7:128096987-128097089
  Hypo

SEQ ID NO: 128305 - DNA, 101 bp, Homo sapiens; identical to SEQ ID NO: 96341
  chr7:128097589-128097690
  Hypo

SEQ ID NO: 128306 - DNA, 23 bp, Homo sapiens
  chr7:128126053-128126076
  Hypo
aagaaaagcacaggccgggcgtg

SEQ ID NO: 128307 - DNA, 103 bp, Homo sapiens; identical to SEQ ID NO: 41442
  chr7:128315917-128316020
  Hypo

SEQ ID NO: 128308 - DNA, 138 bp, Homo sapiens; identical to SEQ ID NO: 31541
  chr7:128337405-128337543
  Hyper

SEQ ID NO: 128309 - DNA, 318 bp, Homo sapiens
  chr7:128337603-128337921
  Hyper
gtaggtttttggcttcccgctccctctctctttcccccttttgtcgccgcgcttttcaaccgccccctaactctgctcccccttttactccgtcgcagcccgggacctcctggtgggggtccgccactgcagcaccaggcgccactgccataccaccctgaacgcgcccgatctcgtctgatctcggaagctaagatgtggccgcatttaggaccccaccggcttggctgtgcctctcccagccccctggcggagcggactaaccctagcatttcattgattcacaataacgccaccccaccccgactgactattttg

SEQ ID NO: 128310 - DNA, 247 bp, Homo sapiens
  chr7:128430709-128430956
  Hyper
agagtgaacatcagtcgtgcccactctgagcgggctactgtgggggcgtggctcgcagcccaccgggtgtgggaccggaagggaagacagggcggaggagagggggtcttccggccctgaggcttgatggggccaccggagggctcctcctaagagggtccttggccctggctcggtggggggtcgcggaaagcggagaggtcagggccctgccgttcgcccatccgggcctcgacttccctcctcc

SEQ ID NO: 128311 - DNA, 846 bp, Homo sapiens
  chr7:128470433-128471279
  Hyper
ttaaaccccccgccccggcccagcccgcccttcccgagcaccgctccggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccgggggcgagggcacgggcgctgcggggatagggtcgtcccatggggcaggggcacaggtgcggggtgggcgcgcggggagctgagagacagggcggagggcaccccccggtatagagagaagaccctggccccggccctcccacccatcgacaagggccatgggcactgcctgcacacccctctggggacagcgagcactccctgggtgccccggggagtccaggcc

SEQ ID NO: 128312 - DNA, 30 bp, Homo sapiens; identical to SEQ ID NO: 96354
  chr7:128481374-128481404
  Hypo

SEQ ID NO: 128313 - DNA, 30 bp, Homo sapiens; identical to SEQ ID NO: 96355
  chr7:128482220-128482250
  Hyper

SEQ ID NO: 128314 - DNA, 106 bp, Homo sapiens; identical to SEQ ID NO: 96356
  chr7:128482943-128483049
  Hypo

SEQ ID NO: 128315 - DNA, 50 bp, Homo sapiens; identical to SEQ ID NO: 96357
  chr7:128484931-128484981
  Hypo

SEQ ID NO: 128316 - DNA, 142 bp, Homo sapiens; identical to SEQ ID NO: 96358
  chr7:128486098-128486240
  Hypo

SEQ ID NO: 128317 - DNA, 128 bp, Homo sapiens; identical to SEQ ID NO: 96359
  chr7:128493102-128493230
  Hypo

SEQ ID NO: 128318 - DNA, 30 bp, Homo sapiens; identical to SEQ ID NO: 96360
  chr7:128494242-128494272
  Hypo

SEQ ID NO: 128319 - DNA, 30 bp, Homo sapiens; identical to SEQ ID NO: 96361
  chr7:128507583-128507613
  Hypo

SEQ ID NO: 128320 - DNA, 120 bp, Homo sapiens; identical to SEQ ID NO: 96362
  chr7:128510078-128510198
  Hyper

SEQ ID NO: 128321 - DNA, 40 bp, Homo sapiens; identical to SEQ ID NO: 96363
  chr7:128525170-128525210
  Hypo

SEQ ID NO: 128322 - DNA, 389 bp, Homo sapiens; identical to SEQ ID NO: 96364
  chr7:128528743-128529132
  Hypo

SEQ ID NO: 128323 - DNA, 156 bp, Homo sapiens; identical to SEQ ID NO: 96365
  chr7:128531803-128531959
  Hypo

SEQ ID NO: 128324 - DNA, 41 bp, Homo sapiens; identical to SEQ ID NO: 96366
  chr7:128532991-128533032
  Hypo

SEQ ID NO: 128325 - DNA, 30 bp, Homo sapiens; identical to SEQ ID NO: 41449
  chr7:128533290-128533320
  Hypo

SEQ ID NO: 128326 - DNA, 121 bp, Homo sapiens
  chr7:128550406-128550527
  Hyper
agccgcactctctcccgccgccggctgcaggaaccgcccccctctcctgaaccccctgctttggccgtggtcttccccaccctgctcgctcccccgacggggaggacggagctggccaggg

SEQ ID NO: 128327 - DNA, 30 bp, Homo sapiens; identical to SEQ ID NO: 96368
  chr7:128555645-128555675
  Hyper

SEQ ID NO: 128328 - DNA, 18 bp, Homo sapiens
  chr7:128718421-128718439
  Hypo
acccggccaagaaacttt

SEQ ID NO: 128329 - DNA, 37 bp, Homo sapiens; identical to SEQ ID NO: 96374
  chr7:128767772-128767809
  Hypo

SEQ ID NO: 128330 - DNA, 536 bp, Homo sapiens; identical to SEQ ID NO: 96376
  chr7:128828104-128828640
  Hyper

SEQ ID NO: 128331 - DNA, 475 bp, Homo sapiens; identical to SEQ ID NO: 31549
  chr7:128828904-128829379
  Hyper

SEQ ID NO: 128332 - DNA, 99 bp, Homo sapiens; identical to SEQ ID NO: 96380
  chr7:129142801-129142900
  Hyper

SEQ ID NO: 128333 - DNA, 27 bp, Homo sapiens
  chr7:129229604-129229631
  Hypo
agtcaccgcgcccggccagtcttttct

SEQ ID NO: 128334 - DNA, 30 bp, Homo sapiens; identical to SEQ ID NO: 41451
  chr7:129297274-129297304
  Hypo

SEQ ID NO: 128335 - DNA, 57 bp, Homo sapiens; identical to SEQ ID NO: 96383
  chr7:129330294-129330351
  Hypo

SEQ ID NO: 128336 - DNA, 258 bp, Homo sapiens; identical to SEQ ID NO: 41453
  chr7:129381062-129381320
  Hypo

SEQ ID NO: 128337 - DNA, 30 bp, Homo sapiens; identical to SEQ ID NO: 96385
  chr7:129407651-129407681
  Hypo

SEQ ID NO: 128338 - DNA, 391 bp, Homo sapiens
  chr7:129418271-129418662
  Hyper
attttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtgacaggtagagggtgatgcgcacccgtagagctgagtgacccggcccgagaatccgccacctggctcgcaggattttcgccctcaggagctt

SEQ ID NO: 128339 - DNA, 65 bp, Homo sapiens; identical to SEQ ID NO: 96387
  chr7:129421284-129421349
  Hyper

SEQ ID NO: 128340 - DNA, 1852 bp, Homo sapiens
  chr7:129421630-129423482
  Hyper
ggctgtctctgcacccgcgccctacctggtcctcagacccatgcgatgctgggcaacccgggccgggtgtgcccaggaccgcaaagcgggaagcgcaggccttgcggactgcgagtggcccccgcggcctgctgctcccctttataacgcgcgccccgccccccgcgctccgggcgccccgccctggcccattcacctgctgtcgagaaccagacaccgcgcagcagaaagctagccgctgggccgcgaggtccggccgtcggagcgggcggggctggggcgccgccgagacagatccgatttccaccttttcttaaatgcgctgctgaaagtcgagaaggccccggccggggagctcgcgtcgcttcctcccccctcagctcccctcgcaccctgagtcccccagccccactccgggaggggccgcgaaactgcacccgcaagggcctcatacatattttaaggagcaggccaggcaggtaaccggagctggactcggacggtgagggggcggcccccggggacctgataccctggatcccttacggctcagggctcaggcgggggaagaggtggctcaggacgacctggggtcctcactttgctggcctgtccagcgcatcctaagcccgcgtgtatcctaccccctccttctgcagatccaatgtccgtctggcaattgccccattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgctccagtccctctgtgatctcgatctcgagggattcacttcacctctctaagcctcagtttcccatttgcaaaatgggcagaatgactcgcacctctggggatgaagaaaatgcacatgtgagcacgtgggtacttggcgacccggagatctctgcaaactgcaggcccagcgagatggcctcagcacgccctgcaccctcgtccgcgcgactgccgccgggtgcccgccccagccgctgtgtccctggtgcttcctccgccagggccacgtgccggggaagccaaagcgggagtctttcgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctctttaaaagaatgaggaaaacatggggtctttatatatcctggaaagtcgcctaggcgttcag

SEQ ID NO: 128341 - DNA, 1399 bp, Homo sapiens; identical to SEQ ID NO: 96391
  chr7:129424547-129425946
  Hyper

SEQ ID NO: 128342 - DNA, 30 bp, Homo sapiens; identical to SEQ ID NO: 96392
  chr7:129426289-129426319
  Hyper

SEQ ID NO: 128343 - DNA, 30 bp, Homo sapiens; identical to SEQ ID NO: 41454
  chr7:129782524-129782554
  Hypo

SEQ ID NO: 128344 - DNA, 348 bp, Homo sapiens; identical to SEQ ID NO: 96394
  chr7:129794391-129794739
  Hypo

SEQ ID NO: 128345 - DNA, 41 bp, Homo sapiens; identical to SEQ ID NO: 96395
  chr7:129800321-129800362
  Hypo

SEQ ID NO: 128346 - DNA, 19 bp, Homo sapiens
  chr7:129844190-129844209
  Hypo
ttatttgttttgagacgga

SEQ ID NO: 128347 - DNA, 30 bp, Homo sapiens; identical to SEQ ID NO: 41456
  chr7:129846079-129846109
  Hypo

SEQ ID NO: 128348 - DNA, 30 bp, Homo sapiens; identical to SEQ ID NO: 96398
  chr7:129913242-129913272
  Hyper

SEQ ID NO: 128349 - DNA, 31 bp, Homo sapiens; identical to SEQ ID NO: 96402
  chr7:131011381-131011412
  Hypo

SEQ ID NO: 128350 - DNA, 81 bp, Homo sapiens; identical to SEQ ID NO: 96403
  chr7:131041515-131041596
  Hypo

SEQ ID NO: 128351 - DNA, 147 bp, Homo sapiens; identical to SEQ ID NO: 96405
  chr7:131231034-131231181
  Hypo

SEQ ID NO: 128352 - DNA, 42 bp, Homo sapiens; identical to SEQ ID NO: 96406
  chr7:131240674-131240716
  Hyper

SEQ ID NO: 128353 - DNA, 379 bp, Homo sapiens; identical to SEQ ID NO: 96407
  chr7:131242722-131243101
  Hyper

SEQ ID NO: 128354 - DNA, 65 bp, Homo sapiens; identical to SEQ ID NO: 96408
  chr7:131377139-131377204
  Hyper

SEQ ID NO: 128355 - DNA, 30 bp, Homo sapiens; identical to SEQ ID NO: 96410
  chr7:131422856-131422886
  Hypo

SEQ ID NO: 128356 - DNA, 271 bp, Homo sapiens; identical to SEQ ID NO: 96411
  chr7:131514720-131514991
  Hyper

SEQ ID NO: 128357 - DNA, 30 bp, Homo sapiens; identical to SEQ ID NO: 96414
  chr7:132086857-132086887
  Hypo

SEQ ID NO: 128358 - DNA, 187 bp, Homo sapiens; identical to SEQ ID NO: 96415
  chr7:132099502-132099689
  Hypo

SEQ ID NO: 128359 - DNA, 37 bp, Homo sapiens; identical to SEQ ID NO: 96416
  chr7:132155928-132155965
  Hypo

SEQ ID NO: 128360 - DNA, 37 bp, Homo sapiens; identical to SEQ ID NO: 96417
  chr7:132156085-132156122
  Hypo

SEQ ID NO: 128361 - DNA, 2232 bp, Homo sapiens
  chr7:132260210-132262442
  Hyper
gaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcggcggctctcgggggctgcggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcat

SEQ ID NO: 128362 - DNA, 236 bp, Homo sapiens; identical to SEQ ID NO: 96421
  chr7:132299552-132299788
  Hyper

SEQ ID NO: 128363 - DNA, 332 bp, Homo sapiens; identical to SEQ ID NO: 96422
  chr7:132340002-132340334
  Hyper

SEQ ID NO: 128364 - DNA, 117 bp, Homo sapiens; identical to SEQ ID NO: 41462
  chr7:132418949-132419066
  Hypo

SEQ ID NO: 128365 - DNA, 470 bp, Homo sapiens
  chr7:133811925-133812395
  Hyper
acaggaaagataagcgaacagaacagaccaaagagagaaaaataacagaagagactgagaaaaagaaaagtcaagtggagcgcccactgccccgcctgcagaaggcgagtacgcgcggaggagactacaggccccagaatcctccgcggttccccttgcctggggtcagtctcctaggcaaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcaga

SEQ ID NO: 128366 - DNA, 141 bp, Homo sapiens; identical to SEQ ID NO: 96432
  chr7:134116486-134116627
  Hypo

SEQ ID NO: 128367 - DNA, 1167 bp, Homo sapiens
  chr7:134142965-134144132
  Hyper
attgtcattctcatccggctaggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggccgaccccagcccgctggggaccctgcaagcccgcgcgtggctcccagcacgccgggcgtccgcggggcgagctgctcagggtcactcggggtccctcgccaatacaggccgcgcggagagtgtgaggcgagccccgggcccgcgcccccacgagcacctaccttccaggtacccaaccccaggatgggcatcttggcgccgttgttgagcaggagacggcttgccatggctgctgcgctccccagacccccgcccagtacggtgcggccttggccgcggcgcgtacctttaaatagcccgtgaggtcggcagaaagggcgcctgcggttggcgcgccgctgcgcgaaggagccttctgattggttgcgctgggggtgccgcggcggccttccccaagggtcggcggggatgcttcttccgcctggtcctagtggcagcggattctttccgcccccaacgctcgcccgcgccccgcgtggcagaaaggagttcctcagctgctgtatctggtgggaaagcgaatgctttagcgaaaataacaggca

SEQ ID NO: 128368 - DNA, 30 bp, Homo sapiens
  chr7:134833150-134833180
  Hyper
tctgtgaccctccctcgctcatgtctgtat

SEQ ID NO: 128369 - DNA, 36 bp, Homo sapiens; identical to SEQ ID NO: 96438
  chr7:134864251-134864287
  Hypo

SEQ ID NO: 128370 - DNA, 30 bp, Homo sapiens; identical to SEQ ID NO: 41464
  chr7:134880911-134880941
  Hypo

SEQ ID NO: 128371 - DNA, 157 bp, Homo sapiens
  chr7:134885144-134885301
  Hypo
gagagtgaaagatgccggcagaactgtgtactctctagacaatgacacttgcacacagagaagcttgcacccttctggaagcttcttctactgtgaccctaccttacacatctttgtaaccttagcacccagcaccacgcctcgcataagctgggca

SEQ ID NO: 128372 - DNA, 257 bp, Homo sapiens; identical to SEQ ID NO: 96441
  chr7:134918404-134918661
  Hypo

SEQ ID NO: 128373 - DNA, 30 bp, Homo sapiens; identical to SEQ ID NO: 41467
  chr7:134953117-134953147
  Hypo

SEQ ID NO: 128374 - DNA, 37 bp, Homo sapiens; identical to SEQ ID NO: 41468
  chr7:135125375-135125412
  Hypo

SEQ ID NO: 128375 - DNA, 32 bp, Homo sapiens; identical to SEQ ID NO: 96445
  chr7:135196033-135196065
  Hypo

SEQ ID NO: 128376 - DNA, 32 bp, Homo sapiens; identical to SEQ ID NO: 96446
  chr7:135196365-135196397
  Hypo

SEQ ID NO: 128377 - DNA, 38 bp, Homo sapiens; identical to SEQ ID NO: 96447
  chr7:135234576-135234614
  Hypo

SEQ ID NO: 128378 - DNA, 69 bp, Homo sapiens; identical to SEQ ID NO: 96448
  chr7:135391578-135391647
  Hypo

SEQ ID NO: 128379 - DNA, 30 bp, Homo sapiens; identical to SEQ ID NO: 96449
  chr7:135393097-135393127
  Hypo

SEQ ID NO: 128380 - DNA, 135 bp, Homo sapiens; identical to SEQ ID NO: 15032
  chr7:135401363-135401498
  Hypo

SEQ ID NO: 128381 - DNA, 30 bp, Homo sapiens; identical to SEQ ID NO: 96451
  chr7:135412147-135412177
  Hypo

SEQ ID NO: 128382 - DNA, 41 bp, Homo sapiens; identical to SEQ ID NO: 96452
  chr7:135854543-135854584
  Hypo

SEQ ID NO: 128383 - DNA, 17 bp, Homo sapiens
  chr7:135863468-135863485
  Hypo
tccgtctcaaaaaaaga

SEQ ID NO: 128384 - DNA, 105 bp, Homo sapiens; identical to SEQ ID NO: 96454
  chr7:135898002-135898107
  Hypo

SEQ ID NO: 128385 - DNA, 23 bp, Homo sapiens
  chr7:135965324-135965347
  Hypo
accatgcccggcatgactgctct

SEQ ID NO: 128386 - DNA, 136 bp, Homo sapiens; identical to SEQ ID NO: 96457
  chr7:136327342-136327478
  Hypo

SEQ ID NO: 128387 - DNA, 90 bp, Homo sapiens; identical to SEQ ID NO: 96460
  chr7:136553405-136553495
  Hyper

SEQ ID NO: 128388 - DNA, 2670 bp, Homo sapiens
  chr7:136553555-136556225
  Hyper
ttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccaggtttgaaagtcttgtttgcttctcctttagtggtttggcgtggagggcgggggcagcgtcaatttaactccagtctaaaccacgaacaggtcacagactagccaagtggctgagacgagtgtggggtgcgtgactctgcctgcgcgcgcgccagccccgcagctctcgccagagccttggggtcggttctctcccgcctctcccgcctctcccgccccacccctacagtgtctcggcatcaactaatcttttccttttcttttgcaagatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcgggtctgaaaggaaggggcaaacgaggcacagcgcgaggcgaggtacccctacgattccgacggtcactgagtccagccgaatgtggcgaaagcagcctgggagctgcgctgtcccggcgtcgctccctattccagccccccattccctctactgttgctgacccccctcccgccacccactccagatgcagccatggacaagacaaggagagcttcgtccctcccgcccctcgggttccttcctgctggggtctgaccgcgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactggggaccgctgcacccctccccgcccgcaatgtcccttggagtccgcacctgaggtcccaggcaatcgccgctaacttgtagctctcggacacggacaggtgcggtccatgcctggtgccggtagacgcgcagaaattccacctgtgcgcgctgcccggcgcccctggggcccctcacggggtaagtagagactcatctgggagaggtgaaaattccccagaattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcccgggacgcctgcagccaccgccagggtcatggccatggcccacgcagggctctgcgggtggagaggggaagtcagcctagactccagagagaaaccctggggcaacccgaaaggcctgaggaaaactggaattggggttaggcatgaggggagggagtctctggggaaaacgggccgggctgtgcggagccctgagggctcctgcggctgcagcgctgcaggccgcccgcgtctcgccccgccccgccgctgggcgtccccgccaggagcccacccgcgggcggcagcttttctccatgctgcccagggaagttcgatgcctggtgctgggatgcgccagcgcttctgttcgcttctggcaatcctggcgtctcccaatgaga

SEQ ID NO: 128389 - DNA, 30 bp, Homo sapiens; identical to SEQ ID NO: 96466
  chr7:136849171-136849201
  Hypo

SEQ ID NO: 128390 - DNA, 79 bp, Homo sapiens; identical to SEQ ID NO: 96469
  chr7:137028481-137028560
  Hyper

SEQ ID NO: 128391 - DNA, 36 bp, Homo sapiens; identical to SEQ ID NO: 41476
  chr7:137092635-137092671
  Hypo

SEQ ID NO: 128392 - DNA, 17 bp, Homo sapiens
  chr7:137273241-137273258
  Hypo
agatggagtctcaatcg

SEQ ID NO: 128393 - DNA, 38 bp, Homo sapiens; identical to SEQ ID NO: 96472
  chr7:137285723-137285761
  Hypo

SEQ ID NO: 128394 - DNA, 1199 bp, Homo sapiens
  chr7:137531242-137532441
  Hyper
cagcttctcctccagcgcttcgtccttctccttctggccggcggccgcgggctcgtccagggcagcggcccccgccgccgcggctgaccctgcgccccgcgggtccgcgccgccctcggcgcccaggcagcagctcccggcgccgcttccgctgctgctgctgccgcccgtcgcccctttctcctctcccgccgaggagctggggttcatggcgcccgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcgtataagaagaggcatcccggaaggggcttcaaaccacttaggaccgactgctgaaacga

SEQ ID NO: 128395 - DNA, 206 bp, Homo sapiens; identical to SEQ ID NO: 96476
  chr7:137637131-137637337
  Hypo

SEQ ID NO: 128396 - DNA, 87 bp, Homo sapiens; identical to SEQ ID NO: 96477
  chr7:137664095-137664182
  Hypo

SEQ ID NO: 128397 - DNA, 18 bp, Homo sapiens
  chr7:137693378-137693396
  Hypo
acacggcctcggtgtgtt

SEQ ID NO: 128398 - DNA, 140 bp, Homo sapiens; identical to SEQ ID NO: 96479
  chr7:138042204-138042344
  Hypo

SEQ ID NO: 128399 - DNA, 30 bp, Homo sapiens; identical to SEQ ID NO: 96481
  chr7:138574167-138574197
  Hypo

SEQ ID NO: 128400 - DNA, 38 bp, Homo sapiens; identical to SEQ ID NO: 96482
  chr7:138794899-138794937
  Hyper

SEQ ID NO: 128401 - DNA, 15 bp, Homo sapiens
  chr7:138845476-138845491
  Hypo
cggcccaagtcactt

SEQ ID NO: 128402 - DNA, 74 bp, Homo sapiens; identical to SEQ ID NO: 96484
  chr7:138912533-138912607
  Hypo

SEQ ID NO: 128403 - DNA, 157 bp, Homo sapiens; identical to SEQ ID NO: 96485
  chr7:138913166-138913323
  Hypo

SEQ ID NO: 128404 - DNA, 82 bp, Homo sapiens; identical to SEQ ID NO: 96486
  chr7:138957148-138957230
  Hypo

SEQ ID NO: 128405 - DNA, 82 bp, Homo sapiens; identical to SEQ ID NO: 96487
  chr7:139027220-139027302
  Hypo

SEQ ID NO: 128406 - DNA, 30 bp, Homo sapiens; identical to SEQ ID NO: 96488
  chr7:139106981-139107011
  Hypo

SEQ ID NO: 128407 - DNA, 30 bp, Homo sapiens; identical to SEQ ID NO: 41485
  chr7:139112625-139112655
  Hypo

SEQ ID NO: 128408 - DNA, 86 bp, Homo sapiens; identical to SEQ ID NO: 96490
  chr7:139115423-139115509
  Hypo

SEQ ID NO: 128409 - DNA, 30 bp, Homo sapiens; identical to SEQ ID NO: 96491
  chr7:139123790-139123820
  Hypo

SEQ ID NO: 128410 - DNA, 1194 bp, Homo sapiens
  chr7:139167531-139168725
  Hyper
cggtcagctgcccagcggtccagggctgggcgggtgtgggggtttcggctacgtccacccgacctggcggcgtcggctgccggcgcaggtgagcactcacccgtaagcgttacggcccggggcagcttctcgtcgccgtccaaccccgcgcggggcaacagcgccgcatcctccttctccagccccagctccttgcagcggcagcacgtgggggagcccggggagccggcgcttccttccgcggggctggcccggccctctgcgtcgcagccgctctccgtccgggctgcagccagcggcgagcggcggccccacgtgccgccctgggatggtgcgcgcagcaggagctggtgcgccgggtccgcgtggcgggagaaggcaggggactcgggcaccggcaccttgaggaagcgcgtggagggcctgggcgatggcgtgctgctgccaccggccgcgcccacgggcttcacgcgcacatctacctgcagctccatgggcgcccaggcgctgggcgcaggctcagccccgggcgcctcgccattccggggcagcttgaccaaggcagggcccggtgacggcggctcggggcagaccccgtagcccaggctgagcggcggcacgcgcggggacccggggcgaggcgaaggcggctttttcttgctcgagggctccaggcctgcgcccgccgccttctccacggccccggccggacttgggctgctttcgggaccttcaggttgtcgcaccttcgcgggcacctgcggctgctccagcgtggggaccaggcttcccacgggctccattgggagctctgccccggcttggcctccgggcgcagcctcccaagactcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctgtggctgaggttctgctgccccgacccccttcgggacacagccccggcctccaccaggcactgggagggagctgagaacggcagcggggccaggcgagggttgcagggtgggcgggagctctcgggagaaaagcagaacaccagcggaggcttgtggcagggaacccggagccccgcctgacccttccc

SEQ ID NO: 128411 - DNA, 38 bp, Homo sapiens; identical to SEQ ID NO: 96495
  chr7:139207995-139208033
  Hyper

SEQ ID NO: 128412 - DNA, 565 bp, Homo sapiens
  chr7:139208245-139208810
  Hyper
tagaaccaggtctcccggctccaagactgcgctcccagctcgacagcatccagcctccagcccaggtggcggggtcggggagccggctgtccccgctcctccgcgcctcctccctctccgcccctgccccgccccgcccgggtccacggctcccggctcccgcgcgccgcctcgcgctcctccccagcccggctgtgcgtggaggctgcggctcggcggggcaggcgctgagcgcaccgcggcggcacccggcgcagaggctccagcgcggggagccgggctcagccccggcctgccagcgccgcggtcctagcccacccgaggccggcctggggggcccgcagggcgcgcggagcgccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcg

SEQ ID NO: 128413 - DNA, 30 bp, Homo sapiens; identical to SEQ ID NO: 41486
  chr7:139245499-139245529
  Hypo

SEQ ID NO: 128414 - DNA, 30 bp, Homo sapiens; identical to SEQ ID NO: 96499
  chr7:139546165-139546195
  Hypo

SEQ ID NO: 128415 - DNA, 159 bp, Homo sapiens; identical to SEQ ID NO: 96501
  chr7:139650627-139650786
  Hypo

SEQ ID NO: 128416 - DNA, 30 bp, Homo sapiens; identical to SEQ ID NO: 96502
  chr7:139779255-139779285
  Hypo

SEQ ID NO: 128417 - DNA, 96 bp, Homo sapiens; identical to SEQ ID NO: 96504
  chr7:139842977-139843073
  Hypo

SEQ ID NO: 128418 - DNA, 30 bp, Homo sapiens; identical to SEQ ID NO: 41488
  chr7:139919897-139919927
  Hypo

SEQ ID NO: 128419 - DNA, 195 bp, Homo sapiens; identical to SEQ ID NO: 96506
  chr7:139930151-139930346
  Hyper

SEQ ID NO: 128420 - DNA, 213 bp, Homo sapiens; identical to SEQ ID NO: 96507
  chr7:139938997-139939210
  Hypo

SEQ ID NO: 128421 - DNA, 68 bp, Homo sapiens; identical to SEQ ID NO: 41490
  chr7:140007275-140007343
  Hypo

SEQ ID NO: 128422 - DNA, 232 bp, Homo sapiens; identical to SEQ ID NO: 96509
  chr7:140015548-140015780
  Hypo

SEQ ID NO: 128423 - DNA, 21 bp, Homo sapiens
  chr7:140026923-140026944
  Hypo
acggagcgagattctgtctca

SEQ ID NO: 128424 - DNA, 31 bp, Homo sapiens; identical to SEQ ID NO: 41492
  chr7:140096707-140096738
  Hypo

SEQ ID NO: 128425 - DNA, 30 bp, Homo sapiens; identical to SEQ ID NO: 41493
  chr7:140097278-140097308
  Hypo

SEQ ID NO: 128426 - DNA, 154 bp, Homo sapiens; identical to SEQ ID NO: 96513
  chr7:140156524-140156678
  Hypo

SEQ ID NO: 128427 - DNA, 19 bp, Homo sapiens
  chr7:140176253-140176272
  Hypo
agagcgacactccatctca

SEQ ID NO: 128428 - DNA, 120 bp, Homo sapiens; identical to SEQ ID NO: 96515
  chr7:140180178-140180298
  Hypo

SEQ ID NO: 128429 - DNA, 76 bp, Homo sapiens; identical to SEQ ID NO: 96516
  chr7:140192162-140192238
  Hypo

SEQ ID NO: 128430 - DNA, 153 bp, Homo sapiens; identical to SEQ ID NO: 96517
  chr7:140227048-140227201
  Hypo

SEQ ID NO: 128431 - DNA, 36 bp, Homo sapiens; identical to SEQ ID NO: 96518
  chr7:140268315-140268351
  Hypo

SEQ ID NO: 128432 - DNA, 80 bp, Homo sapiens
  chr7:140339825-140339905
  Hyper
actgcaaatgctgaccgctgtgaggggggcccggctgctcagccgcctcgatgccccgcgcttgcacgcgcacgcacaca

SEQ ID NO: 128433 - DNA, 260 bp, Homo sapiens; identical to SEQ ID NO: 96523
  chr7:140339965-140340225
  Hyper

SEQ ID NO: 128434 - DNA, 454 bp, Homo sapiens; identical to SEQ ID NO: 96524
  chr7:140340551-140341005
  Hyper

SEQ ID NO: 128435 - DNA, 23 bp, Homo sapiens
  chr7:140732424-140732447
  Hypo
gaataggaagagctccggtctac

SEQ ID NO: 128436 - DNA, 226 bp, Homo sapiens; identical to SEQ ID NO: 96526
  chr7:140771324-140771550
  Hyper

SEQ ID NO: 128437 - DNA, 72 bp, Homo sapiens; identical to SEQ ID NO: 31590
  chr7:140771769-140771841
  Hyper

SEQ ID NO: 128438 - DNA, 2138 bp, Homo sapiens
  chr7:140772281-140774419
  Hyper
aagacttagacatttcgtgcctgggaaatggtgcagtttatctttaaggagactagaaaaataagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagaggaggaggcgacgaggggaagccgagtgacccagcctccctcccccaccctctccccattcatctcggcgaccaccgcgcgccgggagccggatcgtgggacgccgaggccaggacgggattctctgcacgctgtcgagtgagccggcatctcggcgcccgggtgggctgcgaagaaaatggtgcaatctgagagcgactgagcccagctgggcagagcagacggggtgccagagtgccaagggctcaggtgcctggagaaaggggcggattgtttggaggggccgggaccggggttttcttcggtgcctgcggcattttctttgcacctgggcggcaggctcccggggctcccgggtgccagatgaagtgaggcggaggcgtcgcgggagagccgggtccggaggcggtcgggtggacactccaggcagaagacggcgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactcc

SEQ ID NO: 128439 - DNA, 36 bp, Homo sapiens; identical to SEQ ID NO: 96532
  chr7:140992705-140992741
  Hypo

SEQ ID NO: 128440 - DNA, 187 bp, Homo sapiens; identical to SEQ ID NO: 96533
  chr7:141007214-141007401
  Hypo

SEQ ID NO: 128441 - DNA, 30 bp, Homo sapiens; identical to SEQ ID NO: 96534
  chr7:141137501-141137531
  Hypo

SEQ ID NO: 128442 - DNA, 236 bp, Homo sapiens; identical to SEQ ID NO: 96535
  chr7:141211363-141211599
  Hyper

SEQ ID NO: 128443 - DNA, 29 bp, Homo sapiens
  chr7:141534669-141534698
  Hypo
caggcgtaagccaccgtgcccggcctcgt

SEQ ID NO: 128444 - DNA, 24 bp, Homo sapiens
  chr7:141557650-141557674
  Hypo
gtgagccaccgtgcccagctgcta

SEQ ID NO: 128445 - DNA, 306 bp, Homo sapiens; identical to SEQ ID NO: 96540
  chr7:143042619-143042925
  Hyper

SEQ ID NO: 128446 - DNA, 84 bp, Homo sapiens; identical to SEQ ID NO: 96541
  chr7:143060085-143060169
  Hyper

SEQ ID NO: 128447 - DNA, 472 bp, Homo sapiens
  chr7:143579623-143580095
  Hyper
tcaccagcagaaatacggacacaaaggggattctctgtccccgatgatttctgatttcggcacacccagacccacggcgcacccatcgcgccccgcacccccgccccggcctcccgccctgccctcccccccgcagcacccaggccgagtccaccgttgctggccccttctccagcctgccaggcttttggagagggccactcaccaggtcaccctgcgatttccacgggggcaggtgggagcgggcagagcctggcgcagagaggaatgcacagggaagaggcttccctgtaccagtgactgggcgaccgagccgggatttgggagcggggaggaggctggagctggaggagaggaggggtttccacgggagtcccctcctccccacttcctcccaggctggagtgggagctccagggggcggcgcttggcgggggacagcgcttctttgtgtcgccggccctggtggctt

SEQ ID NO: 128448 - DNA, 30 bp, Homo sapiens; identical to SEQ ID NO: 96545
  chr7:143737774-143737804
  Hypo

SEQ ID NO: 128449 - DNA, 30 bp, Homo sapiens; identical to SEQ ID NO: 96546
  chr7:144185679-144185709
  Hypo

SEQ ID NO: 128450 - DNA, 30 bp, Homo sapiens; identical to SEQ ID NO: 41496
  chr7:144488206-144488236
  Hypo

SEQ ID NO: 128451 - DNA, 30 bp, Homo sapiens; identical to SEQ ID NO: 96550
  chr7:144565945-144565975
  Hypo

SEQ ID NO: 128452 - DNA, 1497 bp, Homo sapiens
  chr7:145812702-145814199
  Hyper
gcatatgtatgagtacgaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcagggttctaggattacacggcaaatccccaacttcagcaccgcggacagcatcacctcccgcccagggagaggcgcgcgcctccttgctccgcccccgccccagctgatggaccccggccggtcggctcagtctcccttttgctttcaaacgaggccagggcagggcagaagggttttgacagccagaggggtacggtaaggaggaggaagaggaggaggaggcggaggaggaggaggagccgaggagggaaccgagaagggaagagaagggagggcttccctccgcctcgctcgccgcccgggctcacaggagctggcggcggcggcggcggcggcggcgtctcctgctctccgcggctgttgctgctgctcgcgctccgccgcccgggagatgcttcctcgcgcggcgcagcgctgaggccgtgcgtgcgccccggctgcgctgcgcgctccccacatacacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacactt

SEQ ID NO: 128453 - DNA, 22 bp, Homo sapiens
  chr7:146300226-146300248
  Hypo
gggcgaggtggctcacgcctgt

SEQ ID NO: 128454 - DNA, 23 bp, Homo sapiens
  chr7:146757526-146757549
  Hypo
tgtgcaggctgggcacgatggct

SEQ ID NO: 128455 - DNA, 18 bp, Homo sapiens
  chr7:146758938-146758956
  Hypo
ttctttggccgggcacgg

SEQ ID NO: 128456 - DNA, 18 bp, Homo sapiens
  chr7:147750129-147750147
  Hypo
ctccgtctcaaaaaaaca

SEQ ID NO: 128457 - DNA, 19 bp, Homo sapiens
  chr7:147816617-147816636
  Hypo
actccgtctcagaaaaaaa

SEQ ID NO: 128458 - DNA, 58 bp, Homo sapiens; identical to SEQ ID NO: 96565
  chr7:147939618-147939676
  Hyper

SEQ ID NO: 128459 - DNA, 27 bp, Homo sapiens
  chr7:147991189-147991216
  Hypo
ggaaaaagcaggcggtgtttcctattc

SEQ ID NO: 128460 - DNA, 95 bp, Homo sapiens; identical to SEQ ID NO: 96567
  chr7:148224591-148224686
  Hypo

SEQ ID NO: 128461 - DNA, 30 bp, Homo sapiens; identical to SEQ ID NO: 41499
  chr7:148500594-148500624
  Hypo

SEQ ID NO: 128462 - DNA, 20 bp, Homo sapiens
  chr7:148582580-148582600
  Hypo
aggatatttgcaaggcgcgg

SEQ ID NO: 128463 - DNA, 95 bp, Homo sapiens; identical to SEQ ID NO: 5071
  chr7:148640241-148640336
  Hypo

SEQ ID NO: 128464 - DNA, 24 bp, Homo sapiens
  chr7:148819014-148819038
  Hypo
tgtttttttttgagacggagtctc

SEQ ID NO: 128465 - DNA, 213 bp, Homo sapiens; identical to SEQ ID NO: 96572
  chr7:148841978-148842191
  Hypo

SEQ ID NO: 128466 - DNA, 149 bp, Homo sapiens; identical to SEQ ID NO: 41502
  chr7:148846075-148846224
  Hypo

SEQ ID NO: 128467 - DNA, 40 bp, Homo sapiens; identical to SEQ ID NO: 96574
  chr7:148883977-148884017
  Hypo

SEQ ID NO: 128468 - DNA, 37 bp, Homo sapiens; identical to SEQ ID NO: 96575
  chr7:148959621-148959658
  Hyper

SEQ ID NO: 128469 - DNA, 320 bp, Homo sapiens; identical to SEQ ID NO: 96577
  chr7:149111906-149112226
  Hyper

SEQ ID NO: 128470 - DNA, 139 bp, Homo sapiens
  chr7:149112286-149112425
  Hyper
taagctatacccccgtcacacgggaggaaagcgtcactcacgtcttcgtagtcagccgcacgcaagccgcgtacagcactgcagggtccgcgctttgggcggcgcttttctccggcggccagttcggacctttgcgctt

SEQ ID NO: 128471 - DNA, 38 bp, Homo sapiens; identical to SEQ ID NO: 96579
  chr7:149118656-149118694
  Hypo

SEQ ID NO: 128472 - DNA, 184 bp, Homo sapiens; identical to SEQ ID NO: 96580
  chr7:149119889-149120073
  Hyper

SEQ ID NO: 128473 - DNA, 172 bp, Homo sapiens; identical to SEQ ID NO: 96581
  chr7:149159300-149159472
  Hypo

SEQ ID NO: 128474 - DNA, 30 bp, Homo sapiens; identical to SEQ ID NO: 96582
  chr7:149184025-149184055
  Hypo

SEQ ID NO: 128475 - DNA, 32 bp, Homo sapiens; identical to SEQ ID NO: 96583
  chr7:149389639-149389671
  Hyper

SEQ ID NO: 128476 - DNA, 57 bp, Homo sapiens
  chr7:149389898-149389955
  Hyper
tgcgacggccggccccgtgcggccccagcccgccctcgcctccgcaccctggggagc

SEQ ID NO: 128477 - DNA, 1070 bp, Homo sapiens
  chr7:149411339-149412409
  Hyper
cagaggagagtgggccgcgcttccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccccggctggtctcggcgcgcaacctctacccgcagctgggggcggggacgaggggagggggcggggacgaggcccgagccaggtccgccccgccctgtctccgccccccgcttccgagccggcgccgcggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcc

SEQ ID NO: 128478 - DNA, 143 bp, Homo sapiens; identical to SEQ ID NO: 96587
  chr7:149427347-149427490
  Hypo

SEQ ID NO: 128479 - DNA, 30 bp, Homo sapiens; identical to SEQ ID NO: 96588
  chr7:149480372-149480402
  Hypo

SEQ ID NO: 128480 - DNA, 30 bp, Homo sapiens; identical to SEQ ID NO: 96589
  chr7:149489914-149489944
  Hypo

SEQ ID NO: 128481 - DNA, 47 bp, Homo sapiens; identical to SEQ ID NO: 96590
  chr7:149513473-149513520
  Hypo

SEQ ID NO: 128482 - DNA, 141 bp, Homo sapiens; identical to SEQ ID NO: 96591
  chr7:149518573-149518714
  Hypo

SEQ ID NO: 128483 - DNA, 40 bp, Homo sapiens; identical to SEQ ID NO: 96592
  chr7:149529824-149529864
  Hypo

SEQ ID NO: 128484 - DNA, 729 bp, Homo sapiens
  chr7:149744409-149745138
  Hyper
ccagggaacgtaaggcgaattccagatcccagcaggcgcagtacccaaaccccgctctctccagccaccaactcccggccgccgcggctgcagacacagacccgctccctccgggacggcgatgaccgcgatctggcgccacggagcctgtctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctgcgcccgcgggccgaggggcttggctcctgcgccgccgtcctcctcgggcccctggccgcccaggaggtgactcgcctccgggggcgtggggaaggacctcgaggtgttgatcttgccggtgaacctctggtacagcgaagccatcgggcaccgcgctcctgctggctgtctttagggctttttaatattttgctttctctccggttcccactccccaccccgctccagattaaaaaaaaggcggtggggaggcagcagcagcagcaaggcaagcccagcgccggcgaccgctcctcccgcgcgccactcgcgagtctccgctggcgactctacctggct

SEQ ID NO: 128485 - DNA, 80 bp, Homo sapiens
  chr7:149745575-149745655
  Hyper
gcggtgggggagtcccgggagctgagggttctgcggccccgccgaaggtagtgctgcgcgtgccccgcagcacgcgagcg

SEQ ID NO: 128486 - DNA, 285 bp, Homo sapiens
  chr7:149917110-149917395
  Hyper
agccctgctgctggccgcgggtctacaaaacagcatacgttctctcaacccctgcgatccgccaaccatcctcagtcaccgacccctgcaagggatgcagacgcaccagcggctgctcacactccctccacaaacctgccggagtctccactcgcccgccaactgtagcctccatctgcgccccacgcccccgcacaagccccctccgtcgcgggtctcttaccttgtggcctttccccgggggatacctgacgctattggagactcctgcggtttgattcatgt

SEQ ID NO: 128487 - DNA, 504 bp, Homo sapiens
  chr7:149917773-149918277
  Hyper
ctaggctctttcctgcgcaaggggtggggaaacccgcgaaagccagggagtcgcgcgcactcacgccctcccgccaccagggcagagccaccgctgcaaggagcccacgggtgcgcgctccgctccagggcggatctttccacacccccctcaccctcaaaagctcaggctggagcggtcatcagtgcggactccggcaccccacccacccagcaggggttaaggagggactggtgcccactcttgcctacagctcctgcgcagggctccagccgccaaatcttcccgggatggtcgggaggtggcataagaggttttgccaggaaccactgcacaggcgaaagagagacagtggagtgggcggaggaggagctgggacggcacccgggctcgttagcccaggctgcacgagctacagcggagggatgcgagcgctctgtcagttgagcaggcgctgcgcgcggaggcccggtcggtgccattggttggcggcccaattggctt

SEQ ID NO: 128488 - DNA, 93 bp, Homo sapiens; identical to SEQ ID NO: 41504
  chr7:150049533-150049626
  Hypo

SEQ ID NO: 128489 - DNA, 1037 bp, Homo sapiens; identical to SEQ ID NO: 96603
  chr7:150068543-150069580
  Hypo

SEQ ID NO: 128490 - DNA, 523 bp, Homo sapiens; identical to SEQ ID NO: 96604
  chr7:150069934-150070457
  Hypo

SEQ ID NO: 128491 - DNA, 152 bp, Homo sapiens; identical to SEQ ID NO: 96605
  chr7:150079238-150079390
  Hypo

SEQ ID NO: 128492 - DNA, 185 bp, Homo sapiens; identical to SEQ ID NO: 96606
  chr7:150081081-150081266
  Hypo

SEQ ID NO: 128493 - DNA, 48 bp, Homo sapiens; identical to SEQ ID NO: 96607
  chr7:150101959-150102007
  Hyper

SEQ ID NO: 128494 - DNA, 238 bp, Homo sapiens; identical to SEQ ID NO: 96609
  chr7:150497647-150497885
  Hyper

SEQ ID NO: 128495 - DNA, 87 bp, Homo sapiens; identical to SEQ ID NO: 96611
  chr7:150554703-150554790
  Hypo

SEQ ID NO: 128496 - DNA, 30 bp, Homo sapiens; identical to SEQ ID NO: 96612
  chr7:150609213-150609243
  Hypo

SEQ ID NO: 128497 - DNA, 38 bp, Homo sapiens; identical to SEQ ID NO: 96613
  chr7:150653091-150653129
  Hyper

SEQ ID NO: 128498 - DNA, 203 bp, Homo sapiens
  chr7:150655182-150655385
  Hyper
cggcgcgcatggcctcgatgtcgtcggccgacgaggcgcggcgcacgctggcgcagctttctcgggagcgcgtccgggccaggctgcagctggagcccgaggcgtcggggttgaggctgtgcgcccggggcgatgggagctggccgggcgcgctgcggggcggagagccgggacccaccagcgcacgccgctcctccgcgggc

SEQ ID NO: 128499 - DNA, 30 bp, Homo sapiens; identical to SEQ ID NO: 96614
  chr7:150660247-150660277
  Hyper

SEQ ID NO: 128500 - DNA, 243 bp, Homo sapiens; identical to SEQ ID NO: 96615
  chr7:150715080-150715323
  Hyper

SEQ ID NO: 128501 - DNA, 742 bp, Homo sapiens; identical to SEQ ID NO: 96616
  chr7:150715618-150716360
  Hyper

SEQ ID NO: 128502 - DNA, 294 bp, Homo sapiens; identical to SEQ ID NO: 96617
  chr7:150746049-150746343
  Hypo

SEQ ID NO: 128503 - DNA, 542 bp, Homo sapiens; identical to SEQ ID NO: 96618
  chr7:150748043-150748585
  Hyper

SEQ ID NO: 128504 - DNA, 156 bp, Homo sapiens; identical to SEQ ID NO: 96619
  chr7:150753912-150754068
  Hypo

SEQ ID NO: 128505 - DNA, 267 bp, Homo sapiens; identical to SEQ ID NO: 96620
  chr7:150758966-150759233
  Hypo

SEQ ID NO: 128506 - DNA, 171 bp, Homo sapiens; identical to SEQ ID NO: 96621
  chr7:150773894-150774065
  Hypo

SEQ ID NO: 128507 - DNA, 33 bp, Homo sapiens; identical to SEQ ID NO: 41512
  chr7:150774325-150774358
  Hypo

SEQ ID NO: 128508 - DNA, 153 bp, Homo sapiens; identical to SEQ ID NO: 96623
  chr7:150774704-150774857
  Hypo

SEQ ID NO: 128509 - DNA, 73 bp, Homo sapiens; identical to SEQ ID NO: 41514
  chr7:150811286-150811359
  Hypo

SEQ ID NO: 128510 - DNA, 30 bp, Homo sapiens; identical to SEQ ID NO: 96625
  chr7:150813180-150813210
  Hypo

SEQ ID NO: 128511 - DNA, 330 bp, Homo sapiens; identical to SEQ ID NO: 41515
  chr7:150823565-150823895
  Hypo

SEQ ID NO: 128512 - DNA, 30 bp, Homo sapiens; identical to SEQ ID NO: 96627
  chr7:150826816-150826846
  Hypo

SEQ ID NO: 128513 - DNA, 705 bp, Homo sapiens
  chr7:150864219-150864924
  Hyper
ggctcggggttgtttcgggcggcagtggcggcggcggcggcagcggcggcggcgagctcctggggcccgtagaaagcgtcgggcggctccgcgaagctgggcagcgcggtggtcagcgccaccatcgagggcacagcctgacccagccccgcgcagaaggtgttggtaaggcggccggcgaaagaggctagcggggcgaggggcgggaggccagcgggcagcggcgcaggggccagcgcctgcggcagcacgagcggccggtagggcatgaacatggggtagccggtgtacagcaagtggccggagcgcggcggcggcggcccgattagggagtcgatggagaaggcagtgcccgggcccccgccgccgcccccgccgttgcccccaggggcgctaccgcctccggcccgctgcatcttgttcggagctgcggccgccccggggcgctcctctctgggcgcctccgtgcgccccgcggctcgggcgccccgcgcggacacgcagggctcgctccctggctcccgggccgaggtggcggcggggcgcgggctcggcgcagtgtggctccggcgccgcgctccctctctctcataaggagggagggggcgggcgagcaggcgggctgggggtgtcgccctccggactcatccatcttcctcaaattacgcttcatttcctccctccgcccgccgccgccgcgcccgg

SEQ ID NO: 128514 - DNA, 399 bp, Homo sapiens; identical to SEQ ID NO: 96630
  chr7:150870816-150871215
  Hypo

SEQ ID NO: 128515 - DNA, 136 bp, Homo sapiens; identical to SEQ ID NO: 96631
  chr7:150872876-150873012
  Hypo

SEQ ID NO: 128516 - DNA, 83 bp, Homo sapiens; identical to SEQ ID NO: 96632
  chr7:150884625-150884708
  Hypo

SEQ ID NO: 128517 - DNA, 30 bp, Homo sapiens; identical to SEQ ID NO: 96633
  chr7:151077135-151077165
  Hypo

SEQ ID NO: 128518 - DNA, 76 bp, Homo sapiens; identical to SEQ ID NO: 96634
  chr7:151082136-151082212
  Hypo

SEQ ID NO: 128519 - DNA, 48 bp, Homo sapiens; identical to SEQ ID NO: 96635
  chr7:151088640-151088688
  Hypo

SEQ ID NO: 128520 - DNA, 1635 bp, Homo sapiens
  chr7:151106208-151107843
  Hyper
agggagatttcctgccgctggttgacaaatgatcttcgcctttgtagcggacgcccctcgacccacccacccgatcccggccgcaccctgctctgcacccgcaccccacccccagacctcaccctgccctgccgtgcgctcaacagccagatgctgggcccagacaagcgctcttccgctagtgtgccgggatgagcgggggctggacttctagaaaggggtctgcgggcgcaggagctggggtccgcggtctggggccggtgagctgcggcgaagaggtcagggagggagtgggagggtctaccttgcaggagcgcgcagcactggccgtccgcggtgctccagagccgggccgtgccgtcctcgctgcccgtcagcaggcgctgcccgtcggggctcaggctcagccagttgatgcccccgcggtggtcggcgcagaccctcagggccgacccgccgccccccatcccgctggcagggcggggaacaagaaggagctgcgccccgctagggaggggcgccccggggtccgcgcggcggctccgtacgactgcggcccgcggccatcgcggggaacggggagcccgactcctgcggaggcacgcggcgaggggagggtgaaggaccctagctccccgctgcctccagcctctgggcccgcgaacccagggcgctgcggggggcggcccactcgggacctccgccctgggtagagtcctgggcgcgcgggcagagagaacccccttcccagcaccgctcggaggatccacaccccaccgggcgaacaaggcagctgcgtctctggtgcacaaggagccccccgcctcctctcgcgcccacggggctggggcggggagaggaacacgggaagccgagcgccccgcgccctccccggccgagcgcggaacaatacggtccagcctggctcctcctcagagaccacccctcacccgatcccctcccacttctcgggctgcgccccagcccccaccccgcgcgcctgcagcctccccccttcgtcgctgtgcgggtccgggggacggctccacgtgcgaccctcctagctgcccgggctgcgcctctgggctctggcctctgccacctccgccgccgccgcctgggtcccctgagccaagggccgggacgagggagggggaggcggacaaagggtcggggtcggggagaatcgcgcgccgggaactcatttggggcgcagctccaccgacccctcggctactcgcctccaccaggcaagccaggtcctcccatgctctgagccctaaggactctgcccgaggggctctcggggacttgggggcggtcccccaatggagggtgcgacagggaaagccccgagtccgccctccctgggaaatcacgcgcacacccaggattctactttggtctggccggagtggggatgaggtgcgagccgctgcggggtcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtc

SEQ ID NO: 128521 - DNA, 81 bp, Homo sapiens; identical to SEQ ID NO: 96640
  chr7:151137032-151137113
  Hyper

SEQ ID NO: 128522 - DNA, 417 bp, Homo sapiens; identical to SEQ ID NO: 96641
  chr7:151145500-151145917
  Hyper

SEQ ID NO: 128523 - DNA, 30 bp, Homo sapiens; identical to SEQ ID NO: 96642
  chr7:151423801-151423831
  Hypo

SEQ ID NO: 128524 - DNA, 32 bp, Homo sapiens; identical to SEQ ID NO: 96643
  chr7:151501814-151501846
  Hypo

SEQ ID NO: 128525 - DNA, 175 bp, Homo sapiens; identical to SEQ ID NO: 96644
  chr7:151553599-151553774
  Hypo

SEQ ID NO: 128526 - DNA, 72 bp, Homo sapiens; identical to SEQ ID NO: 96645
  chr7:151569929-151570001
  Hypo

SEQ ID NO: 128527 - DNA, 198 bp, Homo sapiens; identical to SEQ ID NO: 96646
  chr7:151574921-151575119
  Hyper

SEQ ID NO: 128528 - DNA, 30 bp, Homo sapiens; identical to SEQ ID NO: 41520
  chr7:151585396-151585426
  Hypo

SEQ ID NO: 128529 - DNA, 30 bp, Homo sapiens; identical to SEQ ID NO: 96648
  chr7:151585720-151585750
  Hypo

SEQ ID NO: 128530 - DNA, 336 bp, Homo sapiens; identical to SEQ ID NO: 96649
  chr7:151591649-151591985
  Hypo

SEQ ID NO: 128531 - DNA, 185 bp, Homo sapiens; identical to SEQ ID NO: 96651
  chr7:151706792-151706977
  Hypo

SEQ ID NO: 128532 - DNA, 30 bp, Homo sapiens; identical to SEQ ID NO: 96652
  chr7:151717267-151717297
  Hypo

SEQ ID NO: 128533 - DNA, 36 bp, Homo sapiens; identical to SEQ ID NO: 96653
  chr7:151723170-151723206
  Hyper

SEQ ID NO: 128534 - DNA, 38 bp, Homo sapiens; identical to SEQ ID NO: 96654
  chr7:151812801-151812839
  Hypo

SEQ ID NO: 128535 - DNA, 21 bp, Homo sapiens
  chr7:152085353-152085374
  Hypo
tatgctctggccaggcgtggt

SEQ ID NO: 128536 - DNA, 196 bp, Homo sapiens; identical to SEQ ID NO: 96656
  chr7:152159631-152159827
  Hypo

SEQ ID NO: 128537 - DNA, 40 bp, Homo sapiens; identical to SEQ ID NO: 41523
  chr7:152337514-152337554
  Hypo

SEQ ID NO: 128538 - DNA, 79 bp, Homo sapiens; identical to SEQ ID NO: 96658
  chr7:152371357-152371436
  Hypo

SEQ ID NO: 128539 - DNA, 19 bp, Homo sapiens
  chr7:152374378-152374397
  Hypo
agcttaggcctgaatcgtg

SEQ ID NO: 128540 - DNA, 138 bp, Homo sapiens; identical to SEQ ID NO: 96660
  chr7:152537420-152537558
  Hypo

SEQ ID NO: 128541 - DNA, 30 bp, Homo sapiens; identical to SEQ ID NO: 96661
  chr7:152603655-152603685
  Hypo

SEQ ID NO: 128542 - DNA, 738 bp, Homo sapiens
  chr7:152622496-152623234
  Hyper
gggaacggtggaggccgccgttctcttgggcgcggcctctgctgggggacggcggggatcgcagggccgaggggccgggcgcgcgcgggggagggacccaggccaggggccgctcgcctcggggcggggtctctggagagcgcgcagaggggacgcttcgtgaatgcctgccggcctgaaggatgtcgctgatctctgcccccttcgccaaggccgggccaggcgagtaggggcgcggcctgagcccctgcggtgattccccaggtgtggaatcaaaacagatcccagagcgcgatccgcggggcttttggaaggagccgcccagggctggagattccgacgcaaagacccggaggcccgcggagctgtgggcgcagctggagatggcggaggccccagcagggagtgggggctcggggtccgcagaggcagctccatccccggcgctgggggccgcatggttcccgcaggctgtggccaatcgaggaccgggctccgcattcttcagacgttcctgagccccctcttgccccaacgtccccctcccgggcagccccacagtgggcgattttcccgcactccgcacgagtccatccccatggtggactaggggccgggtctaggctctgcgctacccggccagagcgtccagcggccccactgggcggcggcgccacgcggacgtgggtgggaacagcccccggacccgccgggagaccctcgcggggaagagaagcc

SEQ ID NO: 128543 - DNA, 175 bp, Homo sapiens; identical to SEQ ID NO: 15049
  chr7:152693809-152693984
  Hypo

SEQ ID NO: 128544 - DNA, 42 bp, Homo sapiens; identical to SEQ ID NO: 96666
  chr7:152775969-152776011
  Hypo

SEQ ID NO: 128545 - DNA, 210 bp, Homo sapiens; identical to SEQ ID NO: 96667
  chr7:152782995-152783205
  Hypo

SEQ ID NO: 128546 - DNA, 34 bp, Homo sapiens; identical to SEQ ID NO: 41526
  chr7:152984071-152984105
  Hypo

SEQ ID NO: 128547 - DNA, 23 bp, Homo sapiens
  chr7:153041593-153041616
  Hypo
tttttttttttgagacggagtct

SEQ ID NO: 128548 - DNA, 22 bp, Homo sapiens
  chr7:153041856-153041878
  Hypo
ttacaggcgtaagccaacaagc

SEQ ID NO: 128549 - DNA, 198 bp, Homo sapiens; identical to SEQ ID NO: 96671
  chr7:153102258-153102456
  Hypo

SEQ ID NO: 128550 - DNA, 30 bp, Homo sapiens; identical to SEQ ID NO: 31625
  chr7:153445126-153445156
  Hyper

SEQ ID NO: 128551 - DNA, 245 bp, Homo sapiens
  chr7:153446047-153446292
  Hyper
aggagtctccaatagcgtcaggtgtcccccggggaaaggccacaaggtaagggaccagcgacggagggggcttgtgcgggggcgtggggcgcagatggaggctacagttggccggagagtggagactccggcaggtttgtggagggagtgtgagcagccgctggtgcgtctgcatgccttgcaggggtcggtgactgaggatggttggcggatcgcgggggttgagagaacgtgtgctgttttgt

SEQ ID NO: 128552 - DNA, 22 bp, Homo sapiens
  chr7:153505321-153505343
  Hypo
gcgtgtgtgcacgtgcgtgcgt

SEQ ID NO: 128553 - DNA, 38 bp, Homo sapiens; identical to SEQ ID NO: 96676
  chr7:153519547-153519585
  Hypo

SEQ ID NO: 128554 - DNA, 80 bp, Homo sapiens; identical to SEQ ID NO: 41529
  chr7:153540019-153540099
  Hypo

SEQ ID NO: 128555 - DNA, 1168 bp, Homo sapiens
  chr7:153583302-153584470
  Hyper
tttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagccgtgggcgccagactgggctgcgggaggtcttcggggtcagatcccgcaggcagccaagagcgagccaaagaaacaaagccgccgagggacgcggctggggcggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctc

SEQ ID NO: 128556 - DNA, 368 bp, Homo sapiens; identical to SEQ ID NO: 96680
  chr7:153584779-153585147
  Hyper

SEQ ID NO: 128557 - DNA, 188 bp, Homo sapiens
  chr7:153585418-153585606
  Hyper
gtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggc

SEQ ID NO: 128558 - DNA, 30 bp, Homo sapiens; identical to SEQ ID NO: 41530
  chr7:153641678-153641708
  Hypo

SEQ ID NO: 128559 - DNA, 672 bp, Homo sapiens
  chr7:153749653-153750325
  Hyper
agagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtccc

SEQ ID NO: 128560 - DNA, 30 bp, Homo sapiens; identical to SEQ ID NO: 96685
  chr7:153789907-153789937
  Hypo

SEQ ID NO: 128561 - DNA, 324 bp, Homo sapiens; identical to SEQ ID NO: 96686
  chr7:153820811-153821135
  Hypo

SEQ ID NO: 128562 - DNA, 30 bp, Homo sapiens; identical to SEQ ID NO: 41531
  chr7:153896397-153896427
  Hypo

SEQ ID NO: 128563 - DNA, 21 bp, Homo sapiens
  chr7:154002068-154002089
  Hyper
cgtctccgcggcagtcgctgc

SEQ ID NO: 128564 - DNA, 30 bp, Homo sapiens; identical to SEQ ID NO: 96689
  chr7:154062573-154062603
  Hypo

SEQ ID NO: 128565 - DNA, 30 bp, Homo sapiens; identical to SEQ ID NO: 96690
  chr7:154063085-154063115
  Hypo

SEQ ID NO: 128566 - DNA, 30 bp, Homo sapiens; identical to SEQ ID NO: 96691
  chr7:154065573-154065603
  Hypo

SEQ ID NO: 128567 - DNA, 40 bp, Homo sapiens; identical to SEQ ID NO: 41532
  chr7:154088244-154088284
  Hypo

SEQ ID NO: 128568 - DNA, 66 bp, Homo sapiens; identical to SEQ ID NO: 96693
  chr7:154186455-154186521
  Hypo

SEQ ID NO: 128569 - DNA, 30 bp, Homo sapiens; identical to SEQ ID NO: 96696
  chr7:154438196-154438226
  Hypo

SEQ ID NO: 128570 - DNA, 30 bp, Homo sapiens; identical to SEQ ID NO: 96697
  chr7:154468234-154468264
  Hypo

SEQ ID NO: 128571 - DNA, 30 bp, Homo sapiens; identical to SEQ ID NO: 96698
  chr7:154486585-154486615
  Hypo

SEQ ID NO: 128572 - DNA, 30 bp, Homo sapiens; identical to SEQ ID NO: 96699
  chr7:154540210-154540240
  Hypo

SEQ ID NO: 128573 - DNA, 219 bp, Homo sapiens; identical to SEQ ID NO: 96700
  chr7:154542071-154542290
  Hypo

SEQ ID NO: 128574 - DNA, 39 bp, Homo sapiens; identical to SEQ ID NO: 15050
  chr7:154561150-154561189
  Hypo

SEQ ID NO: 128575 - DNA, 153 bp, Homo sapiens; identical to SEQ ID NO: 96702
  chr7:154597586-154597739
  Hypo

SEQ ID NO: 128576 - DNA, 71 bp, Homo sapiens; identical to SEQ ID NO: 96703
  chr7:154622694-154622765
  Hypo

SEQ ID NO: 128577 - DNA, 153 bp, Homo sapiens; identical to SEQ ID NO: 96704
  chr7:154665013-154665166
  Hypo

SEQ ID NO: 128578 - DNA, 34 bp, Homo sapiens; identical to SEQ ID NO: 96705
  chr7:154667699-154667733
  Hypo

SEQ ID NO: 128579 - DNA, 41 bp, Homo sapiens; identical to SEQ ID NO: 41536
  chr7:154670093-154670134
  Hypo

SEQ ID NO: 128580 - DNA, 30 bp, Homo sapiens; identical to SEQ ID NO: 96707
  chr7:154674338-154674368
  Hypo

SEQ ID NO: 128581 - DNA, 30 bp, Homo sapiens; identical to SEQ ID NO: 96708
  chr7:154675853-154675883
  Hypo

SEQ ID NO: 128582 - DNA, 30 bp, Homo sapiens; identical to SEQ ID NO: 96709
  chr7:154687918-154687948
  Hypo

SEQ ID NO: 128583 - DNA, 30 bp, Homo sapiens; identical to SEQ ID NO: 96710
  chr7:154697056-154697086
  Hypo

SEQ ID NO: 128584 - DNA, 30 bp, Homo sapiens; identical to SEQ ID NO: 96711
  chr7:154708250-154708280
  Hypo

SEQ ID NO: 128585 - DNA, 741 bp, Homo sapiens
  chr7:154861690-154862431
  Hyper
ccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgcgccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacac

SEQ ID NO: 128586 - DNA, 133 bp, Homo sapiens; identical to SEQ ID NO: 96715
  chr7:154922507-154922640
  Hypo

SEQ ID NO: 128587 - DNA, 203 bp, Homo sapiens; identical to SEQ ID NO: 96716
  chr7:154926142-154926345
  Hypo

SEQ ID NO: 128588 - DNA, 30 bp, Homo sapiens; identical to SEQ ID NO: 96717
  chr7:154959001-154959031
  Hypo

SEQ ID NO: 128589 - DNA, 30 bp, Homo sapiens; identical to SEQ ID NO: 96718
  chr7:154982436-154982466
  Hyper

SEQ ID NO: 128590 - DNA, 114 bp, Homo sapiens; identical to SEQ ID NO: 96719
  chr7:155018128-155018242
  Hypo

SEQ ID NO: 128591 - DNA, 145 bp, Homo sapiens; identical to SEQ ID NO: 96720
  chr7:155052879-155053024
  Hypo

SEQ ID NO: 128592 - DNA, 51 bp, Homo sapiens; identical to SEQ ID NO: 96721
  chr7:155053384-155053435
  Hypo

SEQ ID NO: 128593 - DNA, 162 bp, Homo sapiens; identical to SEQ ID NO: 96722
  chr7:155130632-155130794
  Hypo

SEQ ID NO: 128594 - DNA, 44 bp, Homo sapiens; identical to SEQ ID NO: 41539
  chr7:155133192-155133236
  Hypo

SEQ ID NO: 128595 - DNA, 145 bp, Homo sapiens; identical to SEQ ID NO: 96724
  chr7:155144931-155145076
  Hypo

SEQ ID NO: 128596 - DNA, 3494 bp, Homo sapiens
  chr7:155164415-155167909
  Hyper
aacaacttcgtgacccgctccatcccctctttccctgttgcaaggcgagcggaccgcgctgcacgggtccaggctgggtgcccctctcccctggggtaaagaggcagcacaggttgggacagctagatgggggcaatccaggcgtcctgcccacggtttcctgggagccaacaaaggcgccgagacctcacccgtgtgaggcaaccgccccgtggtcccacagagcttctggaagtctgcgtcccggccttcccgatgcaaggcgccctctccacctgcctcggccgtgagcaggttcaggagggcgagaaaggttaggccgagcggaaccgcgcggccagcgttacgcagggtgccctggacacccctaggcgcccacctggacttgttcccacctcctctcgccccttgccttcttaacccgcattacccgtgtaggcctggggtggaatcggactacttgttcgggatttgctcgagaacattctagggagaaggcacgcccggctttgggcttggccgagagtttagggcaggagcgccggcggggagctccccgggtgctggagaatgcgtgtccggaaagaagtagggcgcgcttcgtggatgcaaccagggccgtctcgcgcactttcttcctaccctgggacagcgcctgaactggagctgggcgcacacactttacggagccagctcgggttcttacgccctggctcacccccgcccgccgccccaggatgcaggtgctgcggcgctccctggtagcctcccgcgctccctgggggcgcgctttcctccatttcagggaagtccccggacaggtgcccacgttttacgctgtccggtagaagcccgcgggctcaggccgacttgcgcggccgcttctccccagggagagaagctggagcttcccccacgcggccctaaggcggggccggctgggccggagtgggcgcggccagggtgtcccagcgcgccccctgccgaccgcgcgctgcggggggcaactccacctcccctggggaggcctcgtccccgctgcagggagactaaagcgtgggtccgcgaccagccggtttaggaacgaaaactctggaactaaaaacaaaaaataaaactggtgagtgcgcagcgtggtcagtgtttccctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaaactcactgcaaaattcgccagcgtctcattcttcacacacggggcaccacacgagaatcaccccctccccagaattttgcaaagcacgtttgctgagttttctcgcctttccttccgacaagctcgaactggaaccagcgctctcccctctagacctgcctccgcgccccacccttcttcccccacacagtccctccgcagggagaattcaggtgctaaaaatgctcgggcctcgcagcttcctccctcctcctcggttcctcgaatgacccaagctgcctctttccgggcccttggaagacggtgcgaattccgcggcggcccgctctcgccagcgccacagccctgactcccacccggaggcctgagttcaaccgctttcgcttccttgcgggccgttcaaccctctgaatacgcagattcatttatttatgttttttaatgtagtaagtgggcagctaaatgaattgcaatttgtcatttttatggttaatttgaaatctcgctcttgttgcctaatcctgttagttggtggcaaaacaaggagaaacgcgtgtttcggcagcagtgattctaacaggcgttttatgttaaattacagcagaacccagaacaaaagcaggcggcggacttgcagtcccagcggcctcggccggtccgcgctgccggtgtgagccccgaaggaaagcaccccaagctggctgaccccgcgcacccccggccacacccgcccatcctggcttcgagattaagaagcccagtttggcaccccaattatgtttggcaatgtccccggtgccccagacccgcactccgctgcctcctggcttctcatgcccgcgaagcacggcctcgccctgggcgcggggcatcaccggcgcggaggcccgagggcgggtcacttcggatccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggggagcgggagcaggggcggcccggcgggcgggccgggacccggcttttccggctacccgtgggccaggtgcgggtttcagcacgcggggcgcgtgtgggcggaggcgccggggcccgcggctccgcttgttcgcgcgttgtcgctggcgaggcgtttcttgtccccggcgcccgctcggtgccgtctcagtgagtttgattgaaacgcggctgcgggaaggggtcgacagaggcaagctgcgagcaaggcgggggtgggggcgaggaaggggacccggagagctcccggagggcttggccggccaccgccgcgcggcgctgctcggggactgctactttgcaaggcggcggctgcccctgcggggttcgggttgcagggtcaagtgtcacgtcctccgcaatctccaatattcctgtaatgtatttaaatggacgaattcattacgcggggccgtgtgaatggggcgaggccgcgagcgcggcgcgatcagtagcgcccactaacagttcgttctgcacggcggagcgcgagaccgcggacccacggaagccccctcaatggtgtttgcgtcctcgccgccaccggcttggtagggtcctttagggaaggaggaagagttcaggcacccggacagatcctaatggtctttctgatttttctttcccttcggtccgctttccccgcgacctcctccaccctcagtccgcctttcaaacgtcgtccgcggggatggctgcgcgatggagaaattggtctcgtccagagacgcgcgcacagccgtccccgcgcacacgcgacacgcccagggccggcgtccacgtgagggcagcaccctaggtcgggtcagtcaaaccccacagcggggtttcaaacag

SEQ ID NO: 128597 - DNA, 143 bp, Homo sapiens; identical to SEQ ID NO: 96730
  chr7:155168178-155168321
  Hyper

SEQ ID NO: 128598 - DNA, 85 bp, Homo sapiens; identical to SEQ ID NO: 31641
  chr7:155168529-155168614
  Hyper

SEQ ID NO: 128599 - DNA, 761 bp, Homo sapiens; identical to SEQ ID NO: 96732
  chr7:155170182-155170943
  Hyper

SEQ ID NO: 128600 - DNA, 1251 bp, Homo sapiens; identical to SEQ ID NO: 96733
  chr7:155173869-155175120
  Hyper

SEQ ID NO: 128601 - DNA, 161 bp, Homo sapiens; identical to SEQ ID NO: 96734
  chr7:155202728-155202889
  Hypo

SEQ ID NO: 128602 - DNA, 35 bp, Homo sapiens; identical to SEQ ID NO: 96735
  chr7:155215884-155215919
  Hypo

SEQ ID NO: 128603 - DNA, 30 bp, Homo sapiens; identical to SEQ ID NO: 96736
  chr7:155220048-155220078
  Hypo

SEQ ID NO: 128604 - DNA, 3052 bp, Homo sapiens
  chr7:155241318-155244370
  Hyper
attctcggaggcctgcggtgggagccagggcgcggcggagagggtttcccacctcttccccagcaagcgggagggaggcgccgggctgaggctgcgctgagctcgagctcgccgcccgggtggacccgccctgttcaagcgcggaggggcggaggcctggttgggttgtagcgtggtgcggagcaggacgccgcctcgtgccatggtcactggagacgcacgcccatcttccctcccgggcccgtcgatcctgccatcttccgctcccggccgctcgtgggtgttcgtcatttagaccttccccgtgcttcatgggacgcaagccctcccccagagttcggttttgcaaaagaggtctggagccctcgctacagatcccctccctgggccacggaggatgagaagggtcaccgagccgagccgtaatcctgcgtaacccctgacctctctccttccctgcccccacggcaccccatcgtcccctccccgtctccgaggtcctccagaaaacagcgcagaattgtgcagatgtttaggagatgtgaagatgctggagatgcttaggaggcgacggttacgcgaggagaattgcttccaggtgcgcttctggaacgcacggagatcccccggcggggaaggggccggggctcgcgtcacttagtgtctgctcaccgatttccctctgaagagggggcccagggcctctgctgagggagcggggaggcggtgcgggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcccgggaggcggtggagacccacgcccggaagtaaccggattaggtctcagaatgtgatcgccccccgggtcccgggggagacgccaaggacgcgcaagcggagggcgcggagacaactgggagtcagagtctccatcacttgggctgggaacgcctctgggcgttccgacggggtggcggtgggggtcgggggaggcccttgagaaccgtgcggcccggggagagcccacccattgctgagccccgacacaggctttgaagttgctgcagtggctcagcccctcccccgtccggccctgcgcagcgcggtgccgcagagtccaggccgtgcctccgtttcgtcgctcagagcttattgcggcggctcattggaccacgtcggtggggcgatcgcagcctctgatctgtgagctgcaaagagctccgaggttcattcacaaatctgcgcccccagccgtccctccacgcacccgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaagtggaatgaaaatccagctgggggggtccccatcgacacaactgtcccgcagtcgagcttctggattcctgggagatgtggagagcctggggccggctcccgctccgcagagcagactggactgccctaggtgcctggaatgcgcctgcaccctgtccctcggacccgcgggagacccgtgttccgcaagtcccccttctcaccctagtctgcccctacctacatcccgccggcgagtgtgccaccgcgaggcgcctccttccccgggaagggagctcccttccgcgcagacccgcattgcccttcttttcgctcggttttgttttccaggggtagtttctgcagaaaggagattctcctccgggccgaagggctaccagcctgcagtcagttcagccccggaccctgggagatgctcaccactctgcggatcttgatccgaaatcctttctggccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaaaagcaggcagtgaatgagaacagctcgcatttctccttcctggtagacggggaggtgtaaatcccgaggaattctagggcattcgctccaaacgtgggaaatcttcgcgcgtatcccgtttcttcctccca

SEQ ID NO: 128605 - DNA, 30 bp, Homo sapiens; identical to SEQ ID NO: 96742
  chr7:155244661-155244691
  Hyper

SEQ ID NO: 128606 - DNA, 1836 bp, Homo sapiens
  chr7:155246375-155248211
  Hyper
tgggctcagcacaggcgcttctccagcgatcggggcagaaccaggacgtgcaatgcgactgcccccccctccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttattctgaagaagtctcagaccctagacccagcctcccagaccccgtccccgagctcgcccggtgggcctgtaggccggtcctccttcgcccagaggagagcgcagacacgcaatgtccgcccgttggccccgcccgccccacccctgctccccgcgccccttcgtttcggcctttgtctacaggccgggtcggaacgtcagccccaggagccgacggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggctcgtctgatccgcacagaaaggccgaccttgagggcggcggtcgttcgggggagaaagcggaggctctgggctcgcgggagcgcggcagccggggctggcatcgcagaggagagacacgccactgccccgcatccccagaaagcgcgaggcgccgtcccagctggggcaggcggccgaggccggtcctcatgcgcgcttctcgaagcttcctgaaacaccttgcggagttccgtgtgtatagaactcagcaccgcccagcccctgggcagctcaactttctgcagccccatcccagcttccccggccctttgaacggtgacccctcttaccgctttcccagagttgtttcgtgtttgggtccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggcttt

SEQ ID NO: 128607 - DNA, 4514 bp, Homo sapiens
  chr7:155248614-155253128
  Hyper
ctctgaccagagccacgtccagtggccaggaggccagcccagcacctcctcccccaccattcccgtcctgggtgggggggtaattttcctgggagcagctgtgggaactgtcgtttctcatcccagcccagccagcactctgaagcctgcaggggaaggacagcacgtgggatggacactggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcccgcgcggaggccgaggcggcgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtgagcccgcggggaccacgcgtcccggctcgccgcggggaggcccgcggagctggggggcggtgctggcgcgggaacttaccgggaggaaaacatctcgaacctcccccgcgcacacgcacaaagactcacgcgacattgtgtgaagctgacgccggcccgggcagcggccaggagtccagcggcaggactgattcgctagggggtacagacttcttaggaccgcagaagggaccttctttctttctctgtctctctctctccttcctctctccctgtctcccctctctgtcttccaccccgccttggcgcatctcttcccagcccctagcccatgtctcccccactgtagttttttttggtgggaacgtggtggctggaagatgggcccggaagtgcacactctcatccccttccctacgatcttccaactcaggccaggccggggacgcatgccccagcccaccccagacttgtcctaccatccggttatcccggctgtgctcggggaagaaaaggcgaggccctttgccgctctgccttctgcccctcgggcctgcgctgaccggtgggactcaggaggatgcacacagggaaggaggaaaataaaggcgccctttccccttggctccactttgtttgccagcgccagcccgcagtggtggggctcagcccccttcctgcacacagcgaggacaagggaggcagccgtccctcccggcacctgccatccccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaatttgctccattgttctcgtcttcctcctttgttaatatttaattaacatacaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgggctttaaaatatccctgcaagataatgtttctgttctttggtttctccgaaagaaaggggag

SEQ ID NO: 128608 - DNA, 551 bp, Homo sapiens; identical to SEQ ID NO: 96752
  chr7:155254848-155255399
  Hyper

SEQ ID NO: 128609 - DNA, 201 bp, Homo sapiens
  chr7:155256218-155256419
  Hyper
caccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttgg

SEQ ID NO: 128610 - DNA, 108 bp, Homo sapiens; identical to SEQ ID NO: 96755
  chr7:155257081-155257189
  Hyper

SEQ ID NO: 128611 - DNA, 3521 bp, Homo sapiens
  chr7:155257856-155261377
  Hyper
ccacccgtgctggaccgaggcgctttcccctggggacaggaactttttactccactgagacaaagagactctccttttcaaagtgtcatttttgtttaccttttgttgtttcccccccaaaacaaaagactttgtacaacttcctaagcaggattgggggagggatcagcttcgcctgtgctgaccgcgcctctggattccgctcatcaggaagtgtttggggtctttgagcgagtgatctacgcgttgaattgctgtttttccaaactttcatggcttaaaaattttttttcttctccctgtaaaagaaactcagagactggtgatctgttaccgaagacgactttttaggcgttttctgtttccccaggcagctgggccgttggcgttcccaggcggaagcggggcctctgggctgggcctctgccctgccaggaagcggtctgggggctgcccctcgggattttcagaaccctggaaggagagagctggggtctcaccgcggagactcccgagttctcgttgcctgggcccgagctgcgccccagggtcatcgctgatggcgcgagaccacgcattccccgcgaaccccgacttctgaacagttcagaaagttcgtagattaaaaaccaaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagaccggagtcaggcctgcagggaagtcggtgcgcctttcccaagtcctctgcccgctggttcctctcgggcctcccgggctctgcgtgccgcggatctggacccggactgcagacaccgccccacgactgggcccccggccagactgttaccccacaggaggagggttccctaagtgtgcagaagaggaaagctcatttataaagtccttgctccttcgagctgaacgacccccgcgcccgaggcctagctgtgtccccgccgggcccaggctgagcttactccacactgctccatagccgggcagagactccgcgagggtctgggagtcctggcctcggaggacccgccgccctgcaggcctgcccaagcaggcgcccccgcgagagtgcgggacagagagggcctggcggggctccttggcgctgagagccctccttctccgctgcacccagctctgccaacggggctggatgagtgggggctggagtcagaatcccagggtctacacccgccgacagcagcaatgccgacccgccctgcctttctcctaaggagcggagggaaggagccatgtgaatgaccccagcctgaccaccaagagggcgccagcatttctgttttcctagagtgaaaaggtcaaatcgatgggggctcctacaccgctggacacaggtgcgcccgggcgtccagtgcgcgcaacacacgcccagacactctatatgcaaatatgcctgccgccgcggagccggccgggaggcagcgtttgttcgctggggttctgctagaagtcattctgtctcccgctggtttaatatccgccctctgcggtctccgctcgcctcggcggctcccgaagcgcccccgggagggtcccggctccgccgaaaactgcagcctgccaggctgagccgccgcgcgctgggaggttaatagcgactgacgacaaagggccaaggtgcaattcctaaagcggggattcgccgggtgaggcagaaatcagcctccggggagatgggtccccccttcccgacgcgcccctgcacacactgctgccccggcgccgggcctccgggcggggacccctcttccgggcatcgcggccccattcggcggagagctaggccctctccaggcctccaagtagggagcggacgtgggtggtggggaagggaagccgccggcgggacggagagtggggtcccccggaccctgggtcgggcaggcctggcgctggcagctctgttgcacagatttgtgagcgatgctggtggccgcattgccgcgcggcgcgaaccccaagtagaccattcatgtttttattaataatctcaaacacttcattatatttatgctgcctgcccagagaaaataaaaggccattcttgaaatcgcctgaaatgtaataatattcattaaagcgcctcctaattatgtgatttaatcaagcgtggtgcgcccgcgctctcggctctcgctggaaaggctggcgatgacggttattattactgctgttgttagtggcctcgtgatagcagccggccagctcttcagtccaggcccagtttcctcagagagactcggggagccccactttgagggatggggttccccggaacgactccgaagtcccggagaccaggcgcggcccaggccctctgcccttctccagccccagccccagccccagccccagccccgggcaaactcttccaggccgagggcaggactttctccagacccttggggccctctgtgtcccctggggacgcccgacccggctttctaggagggggaactccgggtcctgagcccgggccccgccccgttggctgttccgccccctccagggctgagccccgcgcaatgcccgaagcagaaacaaagagtcgccgagatctgcctcctgggccgccttttcaccccctcagcctggaaggcgtcccagagaggccccacccccagcctccacggagacccaggagggaagaagagccgggacccggtagccctgaggggctgccgggcctgcggcgctttctccgccgcagaggggttgggtgggagacgcaggcgggaaggaccctgtcccagccgagagtcctctgtggggtcgaggaatggtgaggatcactgtttgcaccaaccgtctggaagaaaccgggcggccagccgctcgaccccatctgtcgagatgtgaaacttggccgcgcggtccgggcgcgcgctgcctgcgcggaaggagccgcctccctcctttcagcgaacgcattcggggttcccccctcccgccaagtcctttgtctggaaggggactggcaggctctgtcgtcgccgtgtgcccccctcctttccccagcctctaccccctccaactaactttcctttcttcccttctcttttcttccctctctggatgggtaatcacaggctccgctgccaagcgcgctgcgaggagccgctgcccgttcccgtcggtgcccctccccgcggcagcctggccgagtccgcccagcc

SEQ ID NO: 128612 - DNA, 238 bp, Homo sapiens; identical to SEQ ID NO: 96763
  chr7:155262357-155262595
  Hyper

SEQ ID NO: 128613 - DNA, 277 bp, Homo sapiens; identical to SEQ ID NO: 96764
  chr7:155264079-155264356
  Hyper

SEQ ID NO: 128614 - DNA, 30 bp, Homo sapiens; identical to SEQ ID NO: 96765
  chr7:155275898-155275928
  Hyper

SEQ ID NO: 128615 - DNA, 139 bp, Homo sapiens; identical to SEQ ID NO: 96766
  chr7:155283645-155283784
  Hyper

SEQ ID NO: 128616 - DNA, 24 bp, Homo sapiens
  chr7:155300117-155300141
  Hyper
aaatggacctcctatcgaaggagc

SEQ ID NO: 128617 - DNA, 24 bp, Homo sapiens
  chr7:155300201-155300225
  Hyper
acagctccccgaaatgattaaacc

SEQ ID NO: 128618 - DNA, 30 bp, Homo sapiens; identical to SEQ ID NO: 96769
  chr7:155301399-155301429
  Hyper

SEQ ID NO: 128619 - DNA, 295 bp, Homo sapiens; identical to SEQ ID NO: 96770
  chr7:155301710-155302005
  Hyper

SEQ ID NO: 128620 - DNA, 1055 bp, Homo sapiens
  chr7:155302308-155303363
  Hyper
aagtctggccctccccggggctgcccttggctgcgcgtcccccacgctgcagccgcgcgatggcccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggctttttccctctccaccctctgctgatcaaagtaggaagtttgcatgacaaccgcagtgaaaggggctgaatcacaaatgaactcgatttctgcagtgttgatctatccagcctccattgtcccctttcaggcgcagtatgaacccttccggtgccagcggccgcgctacattcacaggcgcgctcggggcgcacaaagggtctccgcgcttcaccgccatctggccacaaatctcatcagcggcgcggcggcgtccccttgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatcagctgcgcctcccctgtgcacaggtaacatccctccttctcccccacgactcggctggagcttgattttgagctgctctcaaggcccaggcactcgaatcggaagttaaatagcttatggactatttaatagaatataccaccacacgtatctaatcactcaaataccacgcttttaaaactcatgaatgttttaatcgctaaaaatgtcta

SEQ ID NO: 128621 - DNA, 30 bp, Homo sapiens; identical to SEQ ID NO: 96773
  chr7:155309803-155309833
  Hypo

SEQ ID NO: 128622 - DNA, 30 bp, Homo sapiens; identical to SEQ ID NO: 96774
  chr7:155314707-155314737
  Hypo

SEQ ID NO: 128623 - DNA, 745 bp, Homo sapiens; identical to SEQ ID NO: 31679
  chr7:155325796-155326541
  Hyper

SEQ ID NO: 128624 - DNA, 67 bp, Homo sapiens; identical to SEQ ID NO: 96776
  chr7:155326787-155326854
  Hyper

SEQ ID NO: 128625 - DNA, 229 bp, Homo sapiens; identical to SEQ ID NO: 96777
  chr7:155363288-155363517
  Hypo

SEQ ID NO: 128626 - DNA, 103 bp, Homo sapiens; identical to SEQ ID NO: 96778
  chr7:155436120-155436223
  Hypo

SEQ ID NO: 128627 - DNA, 497 bp, Homo sapiens
  chr7:155579858-155580355
  Hyper
ttgttttttgcggaacgtatgtcgtcaggcggtccttctgtccctgccccaaggtaagccccgaggcgtcccgggcctgcgcccccagcgtccccgcaccagcgccgcgcgacctgccgctggctgcgtccgagcaaggggtccgggcccgcctggctgccccgagggtcccaggaggcagcgcagggacagcccccgcctgagcccgcggctaaaggaggccgggccgccgcgcacccccgcaccccttccccggaccgcgaggctccgcgcgcgcatctctgccgggagctcccgaccacggcccagcgcaagggacctccgggccgcccctgtctcgggccctgccgcgccgcccgcccgctgcaggccaggactgcgctctgtctgcccacggcccccgcctggcacacacgctggggacctttcctcagtgctgcctcgacatccgaaggggctgggacgcccgtccctggtgggagcgagcaccggggcgg

SEQ ID NO: 128628 - DNA, 156 bp, Homo sapiens; identical to SEQ ID NO: 96781
  chr7:155580726-155580882
  Hypo

SEQ ID NO: 128629 - DNA, 635 bp, Homo sapiens; identical to SEQ ID NO: 96782
  chr7:155581242-155581877
  Hypo

SEQ ID NO: 128630 - DNA, 151 bp, Homo sapiens; identical to SEQ ID NO: 96783
  chr7:155582218-155582369
  Hypo

SEQ ID NO: 128631 - DNA, 156 bp, Homo sapiens; identical to SEQ ID NO: 31682
  chr7:155600567-155600723
  Hyper

SEQ ID NO: 128632 - DNA, 390 bp, Homo sapiens; identical to SEQ ID NO: 96785
  chr7:155601020-155601410
  Hyper

SEQ ID NO: 128633 - DNA, 263 bp, Homo sapiens; identical to SEQ ID NO: 96786
  chr7:155601688-155601951
  Hyper

SEQ ID NO: 128634 - DNA, 325 bp, Homo sapiens; identical to SEQ ID NO: 31685
  chr7:155602802-155603127
  Hyper

SEQ ID NO: 128635 - DNA, 98 bp, Homo sapiens; identical to SEQ ID NO: 96788
  chr7:155604921-155605019
  Hyper

SEQ ID NO: 128636 - DNA, 43 bp, Homo sapiens; identical to SEQ ID NO: 96789
  chr7:155605334-155605377
  Hyper

SEQ ID NO: 128637 - DNA, 35 bp, Homo sapiens; identical to SEQ ID NO: 96790
  chr7:155623718-155623753
  Hypo

SEQ ID NO: 128638 - DNA, 30 bp, Homo sapiens; identical to SEQ ID NO: 96791
  chr7:155674904-155674934
  Hypo

SEQ ID NO: 128639 - DNA, 50 bp, Homo sapiens; identical to SEQ ID NO: 96792
  chr7:155683057-155683107
  Hypo

SEQ ID NO: 128640 - DNA, 85 bp, Homo sapiens; identical to SEQ ID NO: 96793
  chr7:155752508-155752593
  Hypo

SEQ ID NO: 128641 - DNA, 105 bp, Homo sapiens; identical to SEQ ID NO: 41547
  chr7:155753582-155753687
  Hypo

SEQ ID NO: 128642 - DNA, 34 bp, Homo sapiens; identical to SEQ ID NO: 41548
  chr7:155786790-155786824
  Hypo

SEQ ID NO: 128643 - DNA, 35 bp, Homo sapiens; identical to SEQ ID NO: 96796
  chr7:155792417-155792452
  Hypo

SEQ ID NO: 128644 - DNA, 30 bp, Homo sapiens; identical to SEQ ID NO: 96798
  chr7:155838899-155838929
  Hypo

SEQ ID NO: 128645 - DNA, 344 bp, Homo sapiens; identical to SEQ ID NO: 96799
  chr7:155854210-155854554
  Hypo

SEQ ID NO: 128646 - DNA, 215 bp, Homo sapiens; identical to SEQ ID NO: 96800
  chr7:155871902-155872117
  Hypo

SEQ ID NO: 128647 - DNA, 141 bp, Homo sapiens; identical to SEQ ID NO: 96801
  chr7:155898166-155898307
  Hypo

SEQ ID NO: 128648 - DNA, 326 bp, Homo sapiens; identical to SEQ ID NO: 96802
  chr7:155898826-155899152
  Hypo

SEQ ID NO: 128649 - DNA, 30 bp, Homo sapiens; identical to SEQ ID NO: 96803
  chr7:155917143-155917173
  Hypo

SEQ ID NO: 128650 - DNA, 34 bp, Homo sapiens; identical to SEQ ID NO: 96804
  chr7:155919137-155919171
  Hypo

SEQ ID NO: 128651 - DNA, 204 bp, Homo sapiens; identical to SEQ ID NO: 96805
  chr7:155920367-155920571
  Hypo

SEQ ID NO: 128652 - DNA, 38 bp, Homo sapiens; identical to SEQ ID NO: 41553
  chr7:156012968-156013006
  Hypo

SEQ ID NO: 128653 - DNA, 266 bp, Homo sapiens; identical to SEQ ID NO: 96807
  chr7:156025663-156025929
  Hypo

SEQ ID NO: 128654 - DNA, 30 bp, Homo sapiens; identical to SEQ ID NO: 96808
  chr7:156124519-156124549
  Hypo

SEQ ID NO: 128655 - DNA, 50 bp, Homo sapiens; identical to SEQ ID NO: 96809
  chr7:156138347-156138397
  Hypo

SEQ ID NO: 128656 - DNA, 197 bp, Homo sapiens; identical to SEQ ID NO: 96810
  chr7:156177617-156177814
  Hypo

SEQ ID NO: 128657 - DNA, 33 bp, Homo sapiens
  chr7:156189973-156190006
  Hypo
tctttccagggcatgcgacgtgatcattttcac

SEQ ID NO: 128658 - DNA, 30 bp, Homo sapiens; identical to SEQ ID NO: 96811
  chr7:156240296-156240326
  Hypo

SEQ ID NO: 128659 - DNA, 30 bp, Homo sapiens; identical to SEQ ID NO: 96812
  chr7:156290677-156290707
  Hypo

SEQ ID NO: 128660 - DNA, 30 bp, Homo sapiens; identical to SEQ ID NO: 96813
  chr7:156397201-156397231
  Hypo

SEQ ID NO: 128661 - DNA, 525 bp, Homo sapiens
  chr7:156409310-156409835
  Hyper
ctgcagaaaagtcaccgtcacacgcagagtccaaaactcccctttccccgctggaaccactttctccaaggagctccgccccgcgctctccccgaccccgtgcgcccccagacctcgcgtcccccgcgctctcccccgccgcgccctcctgccccgcgcccctcctcgccccgaccccgcgcccctgcgcccgggctccagcccggtccctgccgcctcccgcgccccgcgccccgctcctgcccgcggcccgtcccctccctgcagcgcagcgctctgggttcgggtctctgccctctccacccgcctttcccgcgagtcttcttggcttccgtgtccccctccccagccgggcgtcacccccgcaccccgcatctgcgcccccctcccgctaacccgcggcctccgcaagggcagcgcgctcagccgggtgaacctggaactgtgttcctggcccagcgctttcataaaagggcgcggaatagtaagtcctagttcaaggaataaacacggatccccactggc

SEQ ID NO: 128662 - DNA, 257 bp, Homo sapiens; identical to SEQ ID NO: 96816
  chr7:156432918-156433175
  Hyper

SEQ ID NO: 128663 - DNA, 30 bp, Homo sapiens; identical to SEQ ID NO: 96817
  chr7:156507056-156507086
  Hypo

SEQ ID NO: 128664 - DNA, 178 bp, Homo sapiens
  chr7:156701741-156701919
  Hyper
gcaatgcggcctgagcgccagcggggctagggggcgctgaggccacacggaacgccggcgactcactgcgccaggccgggccaccgtgcagaacgcgcgcggatctcacaccccaccatgcggaacgcgcgcgggtcacacaccgcaccgtacggaacacaggcggatcatgattcgt

SEQ ID NO: 128665 - DNA, 105 bp, Homo sapiens; identical to SEQ ID NO: 41557
  chr7:156744694-156744799
  Hypo

SEQ ID NO: 128666 - DNA, 30 bp, Homo sapiens; identical to SEQ ID NO: 96820
  chr7:156778228-156778258
  Hypo

SEQ ID NO: 128667 - DNA, 87 bp, Homo sapiens; identical to SEQ ID NO: 31690
  chr7:156794072-156794159
  Hyper

SEQ ID NO: 128668 - DNA, 26 bp, Homo sapiens
  chr7:156794459-156794485
  Hyper
gtaagccactgcgcccagcctgattt

SEQ ID NO: 128669 - DNA, 1106 bp, Homo sapiens
  chr7:156794998-156796104
  Hyper
cacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccccgggtcgcagtgacggccgccgcaggggtctccccccgcgtaccttcgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccccgagggaccaccgccccaggccgagccgagtcagcgaccccgagcgcggcgcccaggggtgggggtcgcgcccgcaaggcgggcagagccgggcctcgagaccgttcattaggcagaatgaattgttcaccgtgcccggagtggatgaggacgagccagtgattatatttaaatttgctataattgatttggggaagagctactgtgacaagaacgaattgatcattaaatttattagcgagataaattccgcggcgactgagcggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactctt

SEQ ID NO: 128670 - DNA, 3016 bp, Homo sapiens
  chr7:156796494-156799510
  Hyper
tttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggagcggcgtccccgtcgcccgtctcctccggggccaggagaggccactgggtcatcgatgggggaagggggccgggagtcgcgccgggctgggtgggccgcgggcctgcgctcctgggcggacgagagcgcgggctgagcccgcatgtgtgcagcacatggcgctgggcctggctgcggtgattgatggcgcgcgctgcagaggctgattaacccggagccgctgcagccgcggtgtggagcgctgctgcagtccgccgctgtcctcgcggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccac

SEQ ID NO: 128671 - DNA, 225 bp, Homo sapiens; identical to SEQ ID NO: 96830
  chr7:156800853-156801078
  Hyper

SEQ ID NO: 128672 - DNA, 761 bp, Homo sapiens
  chr7:156801403-156802164
  Hyper
ctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccatttta

SEQ ID NO: 128673 - DNA, 124 bp, Homo sapiens; identical to SEQ ID NO: 96833
  chr7:156802413-156802537
  Hyper

SEQ ID NO: 128674 - DNA, 74 bp, Homo sapiens; identical to SEQ ID NO: 96834
  chr7:156803722-156803796
  Hyper

SEQ ID NO: 128675 - DNA, 796 bp, Homo sapiens
  chr7:156808858-156809654
  Hyper
tagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaagtctgcactaattggtctatttagtagttgctgaggtggcaaaagctgcagctgctggtggctgaaagagagagagagagagagagacctcctcttaggccacttcccagagctgtggcagtgggggagggggaattccccaggatggtgtttgtggtcaagttcacctctggcaaccctgcctaagctcttctcacaggtgcacgcattcaagtcctgaagagccctccccgcccccaacagtgttcatgtcccgggctgggggcccgcctgggaggggctctatatgccggtgggacctggctgctttgcctcgcattctccccactcttccccttcccagggcagcttttctccccgcaccccatctctctcccctttgctttctaactgggttgggaagctaatctgccaagagcccgctgcttagc

SEQ ID NO: 128676 - DNA, 1989 bp, Homo sapiens
  chr7:156810037-156812026
  Hyper
gggagcagcatgggccgccctctgcctcaccgaggggcaaaccggctgaggacccaggcacgaagagtgtcaccagctctgaccacaagccccgtagaccagggctgcgtccataatcggggttgatggcattagttattatattataacctccttgttgcgtgattctagtaatttattttcccacttggcctttgactgggctgggctcctcccagtggaacaacagggggtgtcgtgtttgcagcagaaacgcacactgggatcctttcttgcaacagctgggccggctgggtcttttctcttgtcttctgtacacaggcccctctccgctgtttctgcagagaccgaggtgggagggagaaagaccctccagccctctgctcccaccctccccgcagtctccggggccctgtgctgcaggcaagataatttggctaatgaactcgttaaagggcccctggtgacccgccccggcttcccctcggcccatctgggaaattccattgaaaggctggagaaggttcctcagccccgccgccttctgtcgctgctagaggcgcgaacccggtgactctgggccccttacattaaaataattacccggcggaacaggtggcccactcccggcgcctgggtgcatctgggcccccggagccgcagcccgggaggaggggagcggcacgcccaggggagggaaggtcaggcccgctgagccgggagccgggagggtagagaggggctttcctagggacagacggtcccggggcacccaggcctccgcggccgagcgggctgaggcctaagcagggaggccgtcgccttcaggcacaggtaagcgcagcccgcgcaccgcttgggacgcacctggccacctgcgctgccacccaagcttggggtatgcgggtgcccgagcagaaccccgaactcgcaccgggctccgaggttggagcaactcctaacactgggctcggagctaggggcttgctggaggggcgcttgccgcgccggccctcggggctcacagccgggcacgccggactgcggcgagcgcgtgggcgagcgtgtcaggagcgtgcgccctgggtgcgcgcgtgcgagagcgcacgtgtagggtggcttccagtcctcccttcccgcctgagaagcgtccacgcggagttccaggccgggcgctggggaaggaggtcccggggacgctgctgaaaagagagcggccagcccaggcgcggggccaagcctattgccaaaaacatattaccctgcgacattctgtaaatgagataatgatccataaacccggatgatagatgtggcgtgcctgcgatgtcttctctaaatgagctgctcgcatcgactgctaataatggtgagtttatggaagcgatttcagcgcaaactgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgaggttcgcagaggggctgacagcgtggccccccttaactccgagcaccacgacccggatgcacataactgtgtccggaaacttctctttctctgcaggtggagcagcgcctgtgcggctccgcgctatggctccaaggctccggccctggcgtctgggctcggtcggggacagtttccacgcgaggcggagcctagctggaggtcacagggcggtggagagcgagggcatgagggagggagctgggaaccgcgcagtgtccgcggccacgaatctctcctacgcgtccccatgaggcgacctaaggggaag

SEQ ID NO: 128677 - DNA, 37 bp, Homo sapiens; identical to SEQ ID NO: 31706
  chr7:156812242-156812279
  Hyper

SEQ ID NO: 128678 - DNA, 2304 bp, Homo sapiens
  chr7:156812788-156815092
  Hyper
taaggatattgtatacgcggggggtatgctttattgacaatttcattttccaattagtaattttgttgtaatatatctgcgaaccggggactcccgggcagggaggcaggattctcccggctggggcggtctgagtagctgggtctgagcctcgggctgagaagagtaaattctgcagaaagggccgcgtccgatcggcgcaaacgttcggttcgtagcaggagcttctccaggcggccaccgaacccaggtccaggactcggcactcctggagccctcctccccacgcagaccgcgggggctgatttaatagaatgtcgatagaatcattcgatgccttttagcttgtgatctttataaatgtccctctattaaattagaaaatgattctcttctcgtttaattgtattctttcgtttcttatttccaattaattagtcctatcgacgttgcaatattttaagtgacttgagtccgtttccagttagaatatatgggtcagcacatgcaattttatacccgacaggactatataatgtgggttttaactactcgttcctcatctgtcttaaacatctggccaggatgcgccacccggcctcctcgcagatccttcctggggcaggtgggcaccacgcgggaccctcccgggggctcccgcaggcgcctcttgctgcccggggccaagggtcgggcagcccatagcgtccggcctgggcctttacttggaattctttctgttgaagacttggtcccagcccagtggttctgggataagaagaccccgcagaggggcccagcgccgcgttcctacgagacacctgagctgcactgtgtttccacgggctaggagagcggtgactccccagcctccccgtaggcctcgctcgcaccgcagagggatggctggcccgtgccgctccgcggttcccctccccgggcggatccgcgcagggagagcccggcgggcctgggcttgggcctgggcctggttcgggggtgcaggccaagaggggcgccaggccgggctcccctacccgagcacgtcagttccaccccctcccttcttgctgccctacaaaactttaaaatcactttttaaaagaccgtgtctcctctcggcagcccccctcgacctcttcgcaggcgcctgagcagccccgcaccgaggggcgcacctttgcttttgcgagctgcgcggcgcggacacccgggctgcgctcagcccccacccccacaggcttcccagccgtctgcccgagttcggcttcaacgggagcggggctccacttttccttaattgacgaagtcacggattcctcccgggcggatttatggggctgcgcgttgtgccggcgcccgctgcttcgcatctgcgcgcccgcccggtgccgggccccgccctccgcctcagccccaagctcggcccgcgggcccggccacaggtgccccggcggccccgcctggcccgagggaagagggcagctgggaggggccccggccgccgcccgttcctgctgcgggtgagcaccaggtccccgcgggccttgcgcggtgccccccagctcagcgtggcgctcggcggcccaaggtctggggcgtggagggcgtcagcacctggccgactcgccggttcccataggctgcctcgccccgcgttttcctagcgggggatggcggctccccgtgtccgcatcgctgccgggccctgccaccccaaccccggccgcagtggctggaagccgtggccttttccgggctccgagagccggcggggcggttttcctccgggtttcctcccgccggggtcttgggagcccctcagcctcgccctccctgcagggagaaacctgtctactgcgtgaatttctaagcagctgatccttcaggcccaagactcctagagtggaaagggttccccggaatagtaagcgcgccgtcaccttgggtttcttcttcccagagcaaggagacccccgttttcctcatgacccgcgtcctaaaaggtggggaggtgagattcactgggaatcgtgaacctgcccccggcttctcccggggcagcctcccccggtcaggggaggagggagcccttcccttcaaccccgaaaggttccttcctggtccctagctttgctctttgcaggcagggatggggctggcacgccttgcggagaattttaccgttttaaatatggacctagaggccaggtcggaaaggggaaagaagctgcgccttgccgagggtcctgtggccggagcagggcctgactcctgactcccatccagcgccccttctagaaa

SEQ ID NO: 128679 - DNA, 30 bp, Homo sapiens; identical to SEQ ID NO: 96843
  chr7:156815392-156815422
  Hyper

SEQ ID NO: 128680 - DNA, 209 bp, Homo sapiens; identical to SEQ ID NO: 96844
  chr7:156832193-156832402
  Hypo

SEQ ID NO: 128681 - DNA, 500 bp, Homo sapiens; identical to SEQ ID NO: 96845
  chr7:156832680-156833180
  Hypo

SEQ ID NO: 128682 - DNA, 340 bp, Homo sapiens
  chr7:156871012-156871352
  Hyper
gggctcccctaaatccgaagctatcccctgccctcccttcctcgcgtggcttcccgggcgcgctctgcctgtctgcggggactccaggcgtccttgtgttttcagctcccggctcttgcccgcgcgtgtggcccggctgggcgctcgggcttcctcctcccaggcccgcggcggcttcccgtcctcgcaggcgcgatcttaccccggccggacagttaggacgcggttgtgctgacctgaggcttggccctgactcccgtgcacagcgcccgagctccagaggcgggggatctgaacactggcctgtgaaccccgagaaaacccccggtttgcagaccag

SEQ ID NO: 128683 - DNA, 68 bp, Homo sapiens; identical to SEQ ID NO: 41560
  chr7:156880531-156880599
  Hypo

SEQ ID NO: 128684 - DNA, 411 bp, Homo sapiens; identical to SEQ ID NO: 96849
  chr7:156883232-156883643
  Hypo

SEQ ID NO: 128685 - DNA, 31 bp, Homo sapiens; identical to SEQ ID NO: 96850
  chr7:156922797-156922828
  Hypo

SEQ ID NO: 128686 - DNA, 47 bp, Homo sapiens; identical to SEQ ID NO: 96851
  chr7:156924103-156924150
  Hypo

SEQ ID NO: 128687 - DNA, 21 bp, Homo sapiens
  chr7:156929628-156929649
  Hypo
ttatttattttgagacggagt

SEQ ID NO: 128688 - DNA, 30 bp, Homo sapiens; identical to SEQ ID NO: 96853
  chr7:157074398-157074428
  Hypo

SEQ ID NO: 128689 - DNA, 219 bp, Homo sapiens; identical to SEQ ID NO: 96854
  chr7:157075184-157075403
  Hypo

SEQ ID NO: 128690 - DNA, 113 bp, Homo sapiens; identical to SEQ ID NO: 96855
  chr7:157082014-157082127
  Hypo

SEQ ID NO: 128691 - DNA, 212 bp, Homo sapiens; identical to SEQ ID NO: 96856
  chr7:157084410-157084622
  Hypo

SEQ ID NO: 128692 - DNA, 291 bp, Homo sapiens; identical to SEQ ID NO: 96857
  chr7:157085343-157085634
  Hypo

SEQ ID NO: 128693 - DNA, 221 bp, Homo sapiens; identical to SEQ ID NO: 41567
  chr7:157085926-157086147
  Hypo

SEQ ID NO: 128694 - DNA, 71 bp, Homo sapiens; identical to SEQ ID NO: 41568
  chr7:157099869-157099940
  Hypo

SEQ ID NO: 128695 - DNA, 27 bp, Homo sapiens
  chr7:157110643-157110670
  Hypo
ggcatgagccaccgcacccagcccact

SEQ ID NO: 128696 - DNA, 211 bp, Homo sapiens; identical to SEQ ID NO: 96861
  chr7:157129074-157129285
  Hyper

SEQ ID NO: 128697 - DNA, 49 bp, Homo sapiens; identical to SEQ ID NO: 31712
  chr7:157130967-157131016
  Hyper

SEQ ID NO: 128698 - DNA, 41 bp, Homo sapiens; identical to SEQ ID NO: 96863
  chr7:157147812-157147853
  Hypo

SEQ ID NO: 128699 - DNA, 30 bp, Homo sapiens; identical to SEQ ID NO: 96864
  chr7:157151821-157151851
  Hypo

SEQ ID NO: 128700 - DNA, 59 bp, Homo sapiens; identical to SEQ ID NO: 96865
  chr7:157200748-157200807
  Hypo

SEQ ID NO: 128701 - DNA, 48 bp, Homo sapiens; identical to SEQ ID NO: 41570
  chr7:157217366-157217414
  Hypo

SEQ ID NO: 128702 - DNA, 102 bp, Homo sapiens; identical to SEQ ID NO: 96867
  chr7:157217837-157217939
  Hypo

SEQ ID NO: 128703 - DNA, 232 bp, Homo sapiens; identical to SEQ ID NO: 96868
  chr7:157218481-157218713
  Hypo

SEQ ID NO: 128704 - DNA, 153 bp, Homo sapiens; identical to SEQ ID NO: 96869
  chr7:157220472-157220625
  Hypo

SEQ ID NO: 128705 - DNA, 58 bp, Homo sapiens; identical to SEQ ID NO: 96870
  chr7:157233964-157234022
  Hypo

SEQ ID NO: 128706 - DNA, 123 bp, Homo sapiens; identical to SEQ ID NO: 96871
  chr7:157235673-157235796
  Hypo

SEQ ID NO: 128707 - DNA, 178 bp, Homo sapiens; identical to SEQ ID NO: 96872
  chr7:157239495-157239673
  Hypo

SEQ ID NO: 128708 - DNA, 261 bp, Homo sapiens; identical to SEQ ID NO: 41575
  chr7:157255061-157255322
  Hypo

SEQ ID NO: 128709 - DNA, 30 bp, Homo sapiens; identical to SEQ ID NO: 96876
  chr7:157261056-157261086
  Hypo

SEQ ID NO: 128710 - DNA, 944 bp, Homo sapiens; identical to SEQ ID NO: 96877
  chr7:157262527-157263471
  Hypo

SEQ ID NO: 128711 - DNA, 17 bp, Homo sapiens
  chr7:157271529-157271546
  Hypo
ggcgtgaaccaccgcgc

SEQ ID NO: 128712 - DNA, 30 bp, Homo sapiens; identical to SEQ ID NO: 96880
  chr7:157271776-157271806
  Hypo

SEQ ID NO: 128713 - DNA, 92 bp, Homo sapiens; identical to SEQ ID NO: 96882
  chr7:157274739-157274831
  Hypo

SEQ ID NO: 128714 - DNA, 53 bp, Homo sapiens; identical to SEQ ID NO: 96883
  chr7:157276004-157276057
  Hypo

SEQ ID NO: 128715 - DNA, 158 bp, Homo sapiens; identical to SEQ ID NO: 96884
  chr7:157276262-157276420
  Hypo

SEQ ID NO: 128716 - DNA, 256 bp, Homo sapiens; identical to SEQ ID NO: 96885
  chr7:157277538-157277794
  Hypo

SEQ ID NO: 128717 - DNA, 174 bp, Homo sapiens; identical to SEQ ID NO: 96886
  chr7:157280193-157280367
  Hypo

SEQ ID NO: 128718 - DNA, 170 bp, Homo sapiens; identical to SEQ ID NO: 96887
  chr7:157280604-157280774
  Hypo

SEQ ID NO: 128719 - DNA, 409 bp, Homo sapiens; identical to SEQ ID NO: 96888
  chr7:157291421-157291830
  Hypo

SEQ ID NO: 128720 - DNA, 230 bp, Homo sapiens; identical to SEQ ID NO: 96889
  chr7:157294091-157294321
  Hypo

SEQ ID NO: 128721 - DNA, 30 bp, Homo sapiens; identical to SEQ ID NO: 96890
  chr7:157314286-157314316
  Hypo

SEQ ID NO: 128722 - DNA, 30 bp, Homo sapiens; identical to SEQ ID NO: 96891
  chr7:157318443-157318473
  Hypo

SEQ ID NO: 128723 - DNA, 227 bp, Homo sapiens; identical to SEQ ID NO: 96892
  chr7:157319475-157319702
  Hypo

SEQ ID NO: 128724 - DNA, 30 bp, Homo sapiens; identical to SEQ ID NO: 96893
  chr7:157320033-157320063
  Hypo

SEQ ID NO: 128725 - DNA, 63 bp, Homo sapiens; identical to SEQ ID NO: 96894
  chr7:157320767-157320830
  Hypo

SEQ ID NO: 128726 - DNA, 30 bp, Homo sapiens; identical to SEQ ID NO: 96895
  chr7:157332948-157332978
  Hypo

SEQ ID NO: 128727 - DNA, 30 bp, Homo sapiens; identical to SEQ ID NO: 96896
  chr7:157334100-157334130
  Hypo

SEQ ID NO: 128728 - DNA, 71 bp, Homo sapiens; identical to SEQ ID NO: 96897
  chr7:157336122-157336193
  Hypo

SEQ ID NO: 128729 - DNA, 142 bp, Homo sapiens; identical to SEQ ID NO: 41584
  chr7:157337964-157338106
  Hypo

SEQ ID NO: 128730 - DNA, 83 bp, Homo sapiens; identical to SEQ ID NO: 41585
  chr7:157338308-157338391
  Hypo

SEQ ID NO: 128731 - DNA, 30 bp, Homo sapiens; identical to SEQ ID NO: 96900
  chr7:157340396-157340426
  Hypo

SEQ ID NO: 128732 - DNA, 156 bp, Homo sapiens; identical to SEQ ID NO: 96901
  chr7:157341515-157341671
  Hypo

SEQ ID NO: 128733 - DNA, 88 bp, Homo sapiens; identical to SEQ ID NO: 96902
  chr7:157346653-157346741
  Hypo

SEQ ID NO: 128734 - DNA, 155 bp, Homo sapiens; identical to SEQ ID NO: 96903
  chr7:157346979-157347134
  Hypo

SEQ ID NO: 128735 - DNA, 47 bp, Homo sapiens; identical to SEQ ID NO: 96904
  chr7:157347797-157347844
  Hypo

SEQ ID NO: 128736 - DNA, 30 bp, Homo sapiens; identical to SEQ ID NO: 96905
  chr7:157348767-157348797
  Hypo

SEQ ID NO: 128737 - DNA, 76 bp, Homo sapiens; identical to SEQ ID NO: 96906
  chr7:157350791-157350867
  Hypo

SEQ ID NO: 128738 - DNA, 149 bp, Homo sapiens; identical to SEQ ID NO: 96907
  chr7:157352962-157353111
  Hypo

SEQ ID NO: 128739 - DNA, 48 bp, Homo sapiens; identical to SEQ ID NO: 96908
  chr7:157361605-157361653
  Hyper

SEQ ID NO: 128740 - DNA, 39 bp, Homo sapiens; identical to SEQ ID NO: 96909
  chr7:157367437-157367476
  Hypo

SEQ ID NO: 128741 - DNA, 319 bp, Homo sapiens; identical to SEQ ID NO: 96910
  chr7:157370470-157370789
  Hypo

SEQ ID NO: 128742 - DNA, 30 bp, Homo sapiens; identical to SEQ ID NO: 96911
  chr7:157372062-157372092
  Hypo

SEQ ID NO: 128743 - DNA, 30 bp, Homo sapiens; identical to SEQ ID NO: 96912
  chr7:157381230-157381260
  Hypo

SEQ ID NO: 128744 - DNA, 378 bp, Homo sapiens; identical to SEQ ID NO: 96913
  chr7:157396375-157396753
  Hypo

SEQ ID NO: 128745 - DNA, 35 bp, Homo sapiens; identical to SEQ ID NO: 96914
  chr7:157402619-157402654
  Hypo

SEQ ID NO: 128746 - DNA, 202 bp, Homo sapiens; identical to SEQ ID NO: 96915
  chr7:157403604-157403806
  Hypo

SEQ ID NO: 128747 - DNA, 30 bp, Homo sapiens; identical to SEQ ID NO: 96916
  chr7:157404012-157404042
  Hypo

SEQ ID NO: 128748 - DNA, 198 bp, Homo sapiens; identical to SEQ ID NO: 96917
  chr7:157404368-157404566
  Hypo

SEQ ID NO: 128749 - DNA, 175 bp, Homo sapiens; identical to SEQ ID NO: 96918
  chr7:157408585-157408760
  Hypo

SEQ ID NO: 128750 - DNA, 189 bp, Homo sapiens; identical to SEQ ID NO: 96919
  chr7:157409685-157409874
  Hypo

SEQ ID NO: 128751 - DNA, 49 bp, Homo sapiens; identical to SEQ ID NO: 96920
  chr7:157414092-157414141
  Hypo

SEQ ID NO: 128752 - DNA, 101 bp, Homo sapiens; identical to SEQ ID NO: 41594
  chr7:157437497-157437598
  Hypo

SEQ ID NO: 128753 - DNA, 84 bp, Homo sapiens; identical to SEQ ID NO: 96922
  chr7:157443172-157443256
  Hypo

SEQ ID NO: 128754 - DNA, 72 bp, Homo sapiens; identical to SEQ ID NO: 96923
  chr7:157446076-157446148
  Hypo

SEQ ID NO: 128755 - DNA, 123 bp, Homo sapiens; identical to SEQ ID NO: 96924
  chr7:157448403-157448526
  Hypo

SEQ ID NO: 128756 - DNA, 30 bp, Homo sapiens; identical to SEQ ID NO: 96925
  chr7:157448928-157448958
  Hypo

SEQ ID NO: 128757 - DNA, 231 bp, Homo sapiens; identical to SEQ ID NO: 96926
  chr7:157449174-157449405
  Hypo

SEQ ID NO: 128758 - DNA, 106 bp, Homo sapiens; identical to SEQ ID NO: 96927
  chr7:157453759-157453865
  Hypo

SEQ ID NO: 128759 - DNA, 125 bp, Homo sapiens; identical to SEQ ID NO: 96928
  chr7:157455446-157455571
  Hypo

SEQ ID NO: 128760 - DNA, 30 bp, Homo sapiens; identical to SEQ ID NO: 41599
  chr7:157455840-157455870
  Hypo

SEQ ID NO: 128761 - DNA, 53 bp, Homo sapiens; identical to SEQ ID NO: 96930
  chr7:157457934-157457987
  Hypo

SEQ ID NO: 128762 - DNA, 48 bp, Homo sapiens; identical to SEQ ID NO: 96931
  chr7:157462508-157462556
  Hypo

SEQ ID NO: 128763 - DNA, 165 bp, Homo sapiens; identical to SEQ ID NO: 96932
  chr7:157464660-157464825
  Hypo

SEQ ID NO: 128764 - DNA, 110 bp, Homo sapiens; identical to SEQ ID NO: 96933
  chr7:157467603-157467713
  Hypo

SEQ ID NO: 128765 - DNA, 45 bp, Homo sapiens; identical to SEQ ID NO: 96934
  chr7:157468290-157468335
  Hypo

SEQ ID NO: 128766 - DNA, 100 bp, Homo sapiens; identical to SEQ ID NO: 96935
  chr7:157476555-157476655
  Hyper

SEQ ID NO: 128767 - DNA, 1095 bp, Homo sapiens
  chr7:157476871-157477966
  Hyper
gcctccttttgccttcggtgcagcggattagctggtgccgggactgagttaatggaaacgcgggttaaatgagaaaagacgcccggattttcctgcctggatgcgcggctcggaggaggaccgcgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctcggtccccgcgcgggcgctggttctcccgggtgggcggcagccccgccctgtgccctcctgggccggcgcgagggaccctagagcgcgcggggggccccaggcggggaggagcggccgcgaccccggatgcgagaggcgtgtgggtccaagcggcgccgggacaggggccgggtcctctgcccaccccagggtccatgttcgcctgcggggccgcgtcccccggagccatacctgggcgggagggcttttcccgggggcccggcctgcgcccctcgccgcccctcgcccctcgcctctcgcctcccgcgggtcccgcctggccttggccgacggaacaagaacaacaaaggaagcggcgcgaccggcggagggggcgcccgccgccctcccacccctcatcccggccgggccgatggcccccgcgcgcctccatccgccccagcgcggaggcgaccccggccccgctgccccggcgtc

SEQ ID NO: 128768 - DNA, 38 bp, Homo sapiens
  chr7:157478722-157478760
  Hyper
ggacagccggggagtcgtgaccgcgggcagcgccgggg

SEQ ID NO: 128769 - DNA, 5307 bp, Homo sapiens
  chr7:157481364-157486671
  Hyper
ggggggttaccgcttcgcctcctctacccggactcagaagccccaacccaagacccgcctagcgtcgcttgtcagaacccctctgtggcacgactttgagcagagggcgagggaaaggagggtcagcgttcggccccgtcccctgcctgggctttctcccccgcttccccgtccctcccccctcgccggttcaccgcatccccacaggagtcataaagatcaggccccagcgccggacacaaaggccaagggttcccgggagccgcgggtattcagagccaggagaggggtcccggcgcggagggtgctgcggcccagcctcctggccacagagcgcgccggccgcgagggaggaccaaggtccccaaccacgcccgcgtccacccgtgaatcccggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccccggggccgctgtccgaggacggaggtcggtgacttgaaccgcgtcgtcctcagggctgtggcggggcccctctcccagccgtccagcccgcagcgcccagctcagcgcactgaggaccaaaaagggcgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcccgggatgccctcccagggaccttctcgggcaaagagtcgagtggtagcggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggagcgccctagggtctggctgcgccgcgctggcgacggggtaggctcggggaacgcgcgcaggccccgggatcggccgctggggcattggggcatcctgccctcgctgccccgaccctcccgctgcggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctggcgcaccctccccgcccgcggcgacctcgcaccaccttccccgccagcccgcggctctcctcgccctggatcgccggagcctcatccaggctggggtctccagcaggcggccgggagctctccgaggtggccaggagtggccggtagccgtctccctcggccaggccgtgtccagcccctcagtctccacggcggcgcagaccgcacgcggccaccctgggcctcggacagggctagggggacgcagaccctgccgt

SEQ ID NO: 128770 - DNA, 30 bp, Homo sapiens; identical to SEQ ID NO: 96948
  chr7:157505944-157505974
  Hypo

SEQ ID NO: 128771 - DNA, 54 bp, Homo sapiens; identical to SEQ ID NO: 96949
  chr7:157506246-157506300
  Hypo

SEQ ID NO: 128772 - DNA, 44 bp, Homo sapiens; identical to SEQ ID NO: 41600
  chr7:157511451-157511495
  Hypo

SEQ ID NO: 128773 - DNA, 152 bp, Homo sapiens; identical to SEQ ID NO: 41601
  chr7:157512238-157512390
  Hypo

SEQ ID NO: 128774 - DNA, 216 bp, Homo sapiens; identical to SEQ ID NO: 96952
  chr7:157527539-157527755
  Hypo

SEQ ID NO: 128775 - DNA, 30 bp, Homo sapiens; identical to SEQ ID NO: 41603
  chr7:157530181-157530211
  Hypo

SEQ ID NO: 128776 - DNA, 118 bp, Homo sapiens; identical to SEQ ID NO: 96954
  chr7:157536623-157536741
  Hypo

SEQ ID NO: 128777 - DNA, 30 bp, Homo sapiens; identical to SEQ ID NO: 96955
  chr7:157544564-157544594
  Hypo

SEQ ID NO: 128778 - DNA, 58 bp, Homo sapiens; identical to SEQ ID NO: 96956
  chr7:157546564-157546622
  Hypo

SEQ ID NO: 128779 - DNA, 34 bp, Homo sapiens; identical to SEQ ID NO: 96957
  chr7:157550924-157550958
  Hypo

SEQ ID NO: 128780 - DNA, 103 bp, Homo sapiens; identical to SEQ ID NO: 41605
  chr7:157551220-157551323
  Hypo

SEQ ID NO: 128781 - DNA, 153 bp, Homo sapiens; identical to SEQ ID NO: 96959
  chr7:157552297-157552450
  Hypo

SEQ ID NO: 128782 - DNA, 151 bp, Homo sapiens; identical to SEQ ID NO: 96960
  chr7:157565500-157565651
  Hypo

SEQ ID NO: 128783 - DNA, 134 bp, Homo sapiens; identical to SEQ ID NO: 96961
  chr7:157568187-157568321
  Hypo

SEQ ID NO: 128784 - DNA, 62 bp, Homo sapiens; identical to SEQ ID NO: 96962
  chr7:157578615-157578677
  Hypo

SEQ ID NO: 128785 - DNA, 30 bp, Homo sapiens; identical to SEQ ID NO: 96963
  chr7:157581557-157581587
  Hypo

SEQ ID NO: 128786 - DNA, 341 bp, Homo sapiens; identical to SEQ ID NO: 41609
  chr7:157583900-157584241
  Hypo

SEQ ID NO: 128787 - DNA, 30 bp, Homo sapiens; identical to SEQ ID NO: 41610
  chr7:157584643-157584673
  Hypo

SEQ ID NO: 128788 - DNA, 84 bp, Homo sapiens; identical to SEQ ID NO: 96966
  chr7:157585079-157585163
  Hypo

SEQ ID NO: 128789 - DNA, 441 bp, Homo sapiens; identical to SEQ ID NO: 96967
  chr7:157588586-157589027
  Hypo

SEQ ID NO: 128790 - DNA, 35 bp, Homo sapiens; identical to SEQ ID NO: 96968
  chr7:157589600-157589635
  Hypo

SEQ ID NO: 128791 - DNA, 30 bp, Homo sapiens; identical to SEQ ID NO: 41613
  chr7:157601854-157601884
  Hypo

SEQ ID NO: 128792 - DNA, 33 bp, Homo sapiens; identical to SEQ ID NO: 96970
  chr7:157603115-157603148
  Hypo

SEQ ID NO: 128793 - DNA, 349 bp, Homo sapiens; identical to SEQ ID NO: 96971
  chr7:157606439-157606788
  Hypo

SEQ ID NO: 128794 - DNA, 44 bp, Homo sapiens; identical to SEQ ID NO: 96972
  chr7:157607996-157608040
  Hypo

SEQ ID NO: 128795 - DNA, 30 bp, Homo sapiens; identical to SEQ ID NO: 96973
  chr7:157612336-157612366
  Hypo

SEQ ID NO: 128796 - DNA, 31 bp, Homo sapiens; identical to SEQ ID NO: 96974
  chr7:157613184-157613215
  Hypo

SEQ ID NO: 128797 - DNA, 41 bp, Homo sapiens; identical to SEQ ID NO: 96975
  chr7:157624712-157624753
  Hypo

SEQ ID NO: 128798 - DNA, 30 bp, Homo sapiens; identical to SEQ ID NO: 96976
  chr7:157626674-157626704
  Hypo

SEQ ID NO: 128799 - DNA, 123 bp, Homo sapiens; identical to SEQ ID NO: 41615
  chr7:157633412-157633535
  Hypo

SEQ ID NO: 128800 - DNA, 30 bp, Homo sapiens; identical to SEQ ID NO: 41616
  chr7:157642058-157642088
  Hypo

SEQ ID NO: 128801 - DNA, 35 bp, Homo sapiens; identical to SEQ ID NO: 96979
  chr7:157645946-157645981
  Hypo

SEQ ID NO: 128802 - DNA, 30 bp, Homo sapiens; identical to SEQ ID NO: 41617
  chr7:157654407-157654437
  Hypo

SEQ ID NO: 128803 - DNA, 30 bp, Homo sapiens; identical to SEQ ID NO: 96981
  chr7:157655687-157655717
  Hypo

SEQ ID NO: 128804 - DNA, 87 bp, Homo sapiens; identical to SEQ ID NO: 96982
  chr7:157656677-157656764
  Hypo

SEQ ID NO: 128805 - DNA, 217 bp, Homo sapiens; identical to SEQ ID NO: 96983
  chr7:157659256-157659473
  Hypo

SEQ ID NO: 128806 - DNA, 80 bp, Homo sapiens; identical to SEQ ID NO: 96984
  chr7:157660078-157660158
  Hypo

SEQ ID NO: 128807 - DNA, 33 bp, Homo sapiens; identical to SEQ ID NO: 96985
  chr7:157690247-157690280
  Hypo

SEQ ID NO: 128808 - DNA, 30 bp, Homo sapiens; identical to SEQ ID NO: 96986
  chr7:157695195-157695225
  Hypo

SEQ ID NO: 128809 - DNA, 459 bp, Homo sapiens; identical to SEQ ID NO: 96987
  chr7:157702952-157703411
  Hypo

SEQ ID NO: 128810 - DNA, 30 bp, Homo sapiens; identical to SEQ ID NO: 41622
  chr7:157718446-157718476
  Hypo

SEQ ID NO: 128811 - DNA, 49 bp, Homo sapiens; identical to SEQ ID NO: 96989
  chr7:157722602-157722651
  Hypo

SEQ ID NO: 128812 - DNA, 301 bp, Homo sapiens; identical to SEQ ID NO: 96990
  chr7:157776661-157776962
  Hypo

SEQ ID NO: 128813 - DNA, 71 bp, Homo sapiens; identical to SEQ ID NO: 96991
  chr7:157778447-157778518
  Hypo

SEQ ID NO: 128814 - DNA, 35 bp, Homo sapiens; identical to SEQ ID NO: 96992
  chr7:157793339-157793374
  Hypo

SEQ ID NO: 128815 - DNA, 77 bp, Homo sapiens; identical to SEQ ID NO: 96993
  chr7:157793825-157793902
  Hypo

SEQ ID NO: 128816 - DNA, 145 bp, Homo sapiens; identical to SEQ ID NO: 96994
  chr7:157794503-157794648
  Hypo

SEQ ID NO: 128817 - DNA, 30 bp, Homo sapiens; identical to SEQ ID NO: 96995
  chr7:157795418-157795448
  Hypo

SEQ ID NO: 128818 - DNA, 30 bp, Homo sapiens; identical to SEQ ID NO: 96996
  chr7:157853764-157853794
  Hypo

SEQ ID NO: 128819 - DNA, 180 bp, Homo sapiens; identical to SEQ ID NO: 96997
  chr7:157877427-157877607
  Hypo

SEQ ID NO: 128820 - DNA, 43 bp, Homo sapiens; identical to SEQ ID NO: 96998
  chr7:157886934-157886977
  Hypo

SEQ ID NO: 128821 - DNA, 30 bp, Homo sapiens; identical to SEQ ID NO: 96999
  chr7:157890829-157890859
  Hypo

SEQ ID NO: 128822 - DNA, 235 bp, Homo sapiens; identical to SEQ ID NO: 97000
  chr7:157891284-157891519
  Hypo

SEQ ID NO: 128823 - DNA, 193 bp, Homo sapiens; identical to SEQ ID NO: 97001
  chr7:157932110-157932303
  Hypo

SEQ ID NO: 128824 - DNA, 66 bp, Homo sapiens; identical to SEQ ID NO: 97002
  chr7:157934593-157934659
  Hypo

SEQ ID NO: 128825 - DNA, 185 bp, Homo sapiens; identical to SEQ ID NO: 97003
  chr7:157955324-157955509
  Hypo

SEQ ID NO: 128826 - DNA, 158 bp, Homo sapiens; identical to SEQ ID NO: 97004
  chr7:157956509-157956667
  Hypo

SEQ ID NO: 128827 - DNA, 190 bp, Homo sapiens; identical to SEQ ID NO: 97005
  chr7:157958513-157958703
  Hypo

SEQ ID NO: 128828 - DNA, 63 bp, Homo sapiens; identical to SEQ ID NO: 97006
  chr7:157984975-157985038
  Hypo

SEQ ID NO: 128829 - DNA, 124 bp, Homo sapiens; identical to SEQ ID NO: 97007
  chr7:157987024-157987148
  Hypo

SEQ ID NO: 128830 - DNA, 87 bp, Homo sapiens; identical to SEQ ID NO: 97008
  chr7:158037639-158037726
  Hypo

SEQ ID NO: 128831 - DNA, 30 bp, Homo sapiens; identical to SEQ ID NO: 97009
  chr7:158039764-158039794
  Hypo

SEQ ID NO: 128832 - DNA, 266 bp, Homo sapiens; identical to SEQ ID NO: 97010
  chr7:158040050-158040316
  Hypo

SEQ ID NO: 128833 - DNA, 92 bp, Homo sapiens; identical to SEQ ID NO: 97011
  chr7:158046523-158046615
  Hypo

SEQ ID NO: 128834 - DNA, 30 bp, Homo sapiens; identical to SEQ ID NO: 97012
  chr7:158054306-158054336
  Hypo

SEQ ID NO: 128835 - DNA, 176 bp, Homo sapiens; identical to SEQ ID NO: 97013
  chr7:158059198-158059374
  Hypo

SEQ ID NO: 128836 - DNA, 277 bp, Homo sapiens; identical to SEQ ID NO: 97014
  chr7:158059722-158059999
  Hypo

SEQ ID NO: 128837 - DNA, 153 bp, Homo sapiens; identical to SEQ ID NO: 97015
  chr7:158065251-158065404
  Hypo

SEQ ID NO: 128838 - DNA, 120 bp, Homo sapiens; identical to SEQ ID NO: 97016
  chr7:158066949-158067069
  Hypo

SEQ ID NO: 128839 - DNA, 44 bp, Homo sapiens; identical to SEQ ID NO: 97017
  chr7:158075807-158075851
  Hypo

SEQ ID NO: 128840 - DNA, 30 bp, Homo sapiens; identical to SEQ ID NO: 97018
  chr7:158103351-158103381
  Hypo

SEQ ID NO: 128841 - DNA, 103 bp, Homo sapiens; identical to SEQ ID NO: 97019
  chr7:158113168-158113271
  Hypo

SEQ ID NO: 128842 - DNA, 47 bp, Homo sapiens; identical to SEQ ID NO: 97020
  chr7:158144245-158144292
  Hypo

SEQ ID NO: 128843 - DNA, 30 bp, Homo sapiens; identical to SEQ ID NO: 97021
  chr7:158167123-158167153
  Hypo

SEQ ID NO: 128844 - DNA, 145 bp, Homo sapiens; identical to SEQ ID NO: 97022
  chr7:158187594-158187739
  Hypo

SEQ ID NO: 128845 - DNA, 45 bp, Homo sapiens; identical to SEQ ID NO: 97023
  chr7:158188532-158188577
  Hypo

SEQ ID NO: 128846 - DNA, 30 bp, Homo sapiens; identical to SEQ ID NO: 97024
  chr7:158207406-158207436
  Hypo

SEQ ID NO: 128847 - DNA, 33 bp, Homo sapiens; identical to SEQ ID NO: 97025
  chr7:158246475-158246508
  Hypo

SEQ ID NO: 128848 - DNA, 96 bp, Homo sapiens; identical to SEQ ID NO: 97026
  chr7:158249132-158249228
  Hypo

SEQ ID NO: 128849 - DNA, 47 bp, Homo sapiens; identical to SEQ ID NO: 97027
  chr7:158277680-158277727
  Hypo

SEQ ID NO: 128850 - DNA, 205 bp, Homo sapiens; identical to SEQ ID NO: 97028
  chr7:158282122-158282327
  Hypo

SEQ ID NO: 128851 - DNA, 32 bp, Homo sapiens; identical to SEQ ID NO: 97029
  chr7:158282841-158282873
  Hypo

SEQ ID NO: 128852 - DNA, 48 bp, Homo sapiens; identical to SEQ ID NO: 97030
  chr7:158283188-158283236
  Hypo

SEQ ID NO: 128853 - DNA, 436 bp, Homo sapiens; identical to SEQ ID NO: 41640
  chr7:158301251-158301687
  Hypo

SEQ ID NO: 128854 - DNA, 30 bp, Homo sapiens; identical to SEQ ID NO: 97032
  chr7:158319411-158319441
  Hypo

SEQ ID NO: 128855 - DNA, 30 bp, Homo sapiens; identical to SEQ ID NO: 41641
  chr7:158332352-158332382
  Hypo

SEQ ID NO: 128856 - DNA, 291 bp, Homo sapiens; identical to SEQ ID NO: 97034
  chr7:158349456-158349747
  Hypo

SEQ ID NO: 128857 - DNA, 30 bp, Homo sapiens; identical to SEQ ID NO: 97035
  chr7:158355894-158355924
  Hypo

SEQ ID NO: 128858 - DNA, 421 bp, Homo sapiens; identical to SEQ ID NO: 97036
  chr7:158379278-158379699
  Hyper

SEQ ID NO: 128859 - DNA, 117 bp, Homo sapiens; identical to SEQ ID NO: 97037
  chr7:158380279-158380396
  Hyper

SEQ ID NO: 128860 - DNA, 401 bp, Homo sapiens; identical to SEQ ID NO: 97038
  chr7:158380813-158381214
  Hyper

SEQ ID NO: 128861 - DNA, 30 bp, Homo sapiens; identical to SEQ ID NO: 97039
  chr7:158450990-158451020
  Hypo

SEQ ID NO: 128862 - DNA, 30 bp, Homo sapiens; identical to SEQ ID NO: 97040
  chr7:158522269-158522299
  Hypo

SEQ ID NO: 128863 - DNA, 240 bp, Homo sapiens; identical to SEQ ID NO: 41643
  chr7:158550099-158550339
  Hypo

SEQ ID NO: 128864 - DNA, 30 bp, Homo sapiens; identical to SEQ ID NO: 41644
  chr7:158564374-158564404
  Hypo

SEQ ID NO: 128865 - DNA, 18 bp, Homo sapiens
  chr7:158594958-158594976
  Hypo
tccatgtcctatgcacga

SEQ ID NO: 128866 - DNA, 277 bp, Homo sapiens; identical to SEQ ID NO: 97044
  chr7:158766828-158767105
  Hypo

SEQ ID NO: 128867 - DNA, 139 bp, Homo sapiens; identical to SEQ ID NO: 97045
  chr7:158788416-158788555
  Hypo

SEQ ID NO: 128868 - DNA, 30 bp, Homo sapiens; identical to SEQ ID NO: 97046
  chr7:158815031-158815061
  Hypo

SEQ ID NO: 128869 - DNA, 30 bp, Homo sapiens; identical to SEQ ID NO: 97047
  chr7:158817049-158817079
  Hypo

SEQ ID NO: 128870 - DNA, 356 bp, Homo sapiens; identical to SEQ ID NO: 97048
  chr7:158823309-158823665
  Hyper

SEQ ID NO: 128871 - DNA, 93 bp, Homo sapiens; identical to SEQ ID NO: 97049
  chr7:158857187-158857280
  Hypo

SEQ ID NO: 128872 - DNA, 77 bp, Homo sapiens; identical to SEQ ID NO: 97050
  chr7:158868410-158868487
  Hypo

SEQ ID NO: 128873 - DNA, 203 bp, Homo sapiens; identical to SEQ ID NO: 97051
  chr7:158933031-158933234
  Hypo

SEQ ID NO: 128874 - DNA, 1473 bp, Homo sapiens
  chr7:158936522-158937995
  Hyper
tactttccaaggacccgctccgcaaagcgcccaccctcgagggaggaaagccgagctgcgcctccgcgcaaggccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccgcttcagtctccaagaggaaagcaagaaacaaggctcgggtttttttctttcttttttctttcctttttttttaaggttcacagagggaataattcagaactccatgtgcgaaggcacttaatcaacaaacttatgagcagttagttcctccagtgcccttgggaaaaagcaactatttccaaaaggaaactttatttaaccgacgccacgtccccccgacactaaaactaaccagtaagtacagggagggaccgagaggcatctgcggccaacgccaaccccgatctccccgtgaaacgcgcagcccgcgcaggcgcccgcagctcccagctcccgggacggccccgaacgagctcatcgttgacgcgtccaggaagaaacgatcccgtttccagcaaaccccggacggtggggcgcggggaagggcgcaggcagcctcccaacccgagtcccgcaacccggcgggaccggagctcagcgcttcacgctctccgggaggaagctccggaccccgggcgaccccgctccctctcccggaccccgcccgcgctccagcacccgggaggaaggcgaagaccggcgggaggagcgctcttctcggaaggggagaaccgggtccgaggcgccgtggggcgggggtcgcgggcgcactcacgggggcgagcagccagcaggtcagcagcgcgggaggcagcagcgtccgcatcccgagctcagcgtgccgggggccgcccagcgcccgccgcctccgtcctaggtccccgcggttccgccgcctccagcatgggccgggagcgagtgcgcggagacctcgggccccgcagctgtagccgagcgcccgagcgcgggggccgccccctccgtcccggcagctggagcgcgctcaatgcacgcccgtcccccacgcgccccgccgctccgccccccgcccctgtccccgccccgcgctgccccaatcctcgtctccctcctcccccgagaacccccgctccgcgcccctcctcaccgccccccacttccccttccgctgcgccccgcgccctctcctcgcccctgggctctctgtccccgccgcgcgcgctccctctggtctcctcgacccccccagcctctctctccgttctcctcccctcttccctggcccacgcccccctcccggccgcgcctccccgatctgtgggcggaggggctgggaagcggggtgctcagtgcgcgcccggctccgagtagagagaact

SEQ ID NO: 128875 - DNA, 223 bp, Homo sapiens; identical to SEQ ID NO: 97056
  chr7:158938210-158938433
  Hyper

SEQ ID NO: 128876 - DNA, 108 bp, Homo sapiens; identical to SEQ ID NO: 97057
  chr7:158948149-158948257
  Hypo

SEQ ID NO: 128877 - DNA, 30 bp, Homo sapiens; identical to SEQ ID NO: 97058
  chr7:158950620-158950650
  Hypo

SEQ ID NO: 128878 - DNA, 549 bp, Homo sapiens; identical to SEQ ID NO: 97059
  chr7:158963388-158963937
  Hypo

SEQ ID NO: 128879 - DNA, 43 bp, Homo sapiens; identical to SEQ ID NO: 97060
  chr7:159023728-159023771
  Hypo

SEQ ID NO: 128880 - DNA, 128 bp, Homo sapiens; identical to SEQ ID NO: 41648
  chr8:245097-245225
  Hypo

SEQ ID NO: 128881 - DNA, 38 bp, Homo sapiens; identical to SEQ ID NO: 99274
  chr8:273114-273152
  Hypo

SEQ ID NO: 128882 - DNA, 129 bp, Homo sapiens; identical to SEQ ID NO: 99294
  chr8:299672-299801
  Hypo

SEQ ID NO: 128883 - DNA, 30 bp, Homo sapiens; identical to SEQ ID NO: 99304
  chr8:308732-308762
  Hypo

SEQ ID NO: 128884 - DNA, 252 bp, Homo sapiens
  chr8:494235-494487
  Hyper
cgggacgcgagcacccggcgtggacctctgcgtcccgggcccacgacgcccgcgccgcggggtgcgcgcactgcgtccccgctctcctgggactgcgccccgagtaacacgtgcagggggcactgggtcccctgcaagcggcgagaacgccggcagccctggccagttaagcggggagtgggtccacgcggaccacagcggcaactcagcccaggacgagcctcgggtcaagttctccgactccgcactcgg

SEQ ID NO: 128885 - DNA, 32 bp, Homo sapiens
  chr8:494838-494870
  Hyper
gcggctcctgcgggacgcgggcccagtgggcc

SEQ ID NO: 128886 - DNA, 298 bp, Homo sapiens
  chr8:495703-496001
  Hyper
gccgggaggaagcctcgcccagccctggtgggcggtggggccgctggggcctggggcgccgcgggctcggcccggactgacggcggtggggggcggggatggggccgtggtgccgggccgcgcagaacccttgggacccccgcggcgcccaggttggggctcagggcccggagaacgttttcccgcgtggctatggctttgtcagaatcaggagcgggagaggcgcccacagattcctgagggcagaaccgcctggttcccaggccgaaaggagccggcgaggcgacccccgatcccg

SEQ ID NO: 128887 - DNA, 39 bp, Homo sapiens; identical to SEQ ID NO: 99574
  chr8:566435-566474
  Hypo

SEQ ID NO: 128888 - DNA, 178 bp, Homo sapiens; identical to SEQ ID NO: 99617
  chr8:591505-591683
  Hypo

SEQ ID NO: 128889 - DNA, 36 bp, Homo sapiens; identical to SEQ ID NO: 99618
  chr8:592946-592982
  Hypo

SEQ ID NO: 128890 - DNA, 96 bp, Homo sapiens; identical to SEQ ID NO: 99619
  chr8:593203-593299
  Hypo

SEQ ID NO: 128891 - DNA, 168 bp, Homo sapiens; identical to SEQ ID NO: 99654
  chr8:636372-636540
  Hypo

SEQ ID NO: 128892 - DNA, 167 bp, Homo sapiens; identical to SEQ ID NO: 99660
  chr8:644635-644802
  Hypo

SEQ ID NO: 128893 - DNA, 41 bp, Homo sapiens; identical to SEQ ID NO: 99664
  chr8:647337-647378
  Hypo

SEQ ID NO: 128894 - DNA, 2692 bp, Homo sapiens
  chr8:686714-689406
  Hyper
tatgcggtttgttttcgcatcttttacctcatttaaatgccgtagccatgcaggtggaaagcagaaatccatttctgcgtttatgttaaactggggctgagagacttgcccagggtcggtgaccgcccagggatccccataccagcgcgtctagctcccgcgttccgatcccggaagggaaaacccatgatcctggcgagggtccgtccacacgtggccagggtggctgatcttcccggctgctgtggttgtcaacaccacttctccggatcgattttcccttttcctcggctctgtcgtccatacgccactcacagcaaacccaggcggcgggccccctccgagggcgctccttgcgtccggacccaggttctcggggcgccccccggtgggtccccgcgaagccgccgccgcacaccttcctcagcgtagcccgccagtggaaaccgggggaggttctgcctccagcacccaagcggcggccgcacctcgcagtgagaccctcgcaagcgcccgcgcctccctcgccccgcgtcccctctgccccgcgagcccccctgggcgccgagccgactcgaacccgagcgcgagtcccgcgcacaaacgcgccggcgcgtctctaacagcggtccagaaaggctgaccctgcccgggggcgacgggtgtgaccgggtcccccgctaactttcgggcgcggtgagcgtcgcctgcgcgcgccgcggtggaggccgctgctttcccgccgggagcccggcacagtccccgggtgacccgcgcgccccgcgcaacagttggagccgggctgcccgcgcgctccccaagccgggcccttccccagatgcagccgcgcgccggccgccccccagtgcgccggtgcctccctgggcgccgagtgcgcaggcgccggccgtgaagaccgaccgtgcgccgggctcgagcgcggtctgagcgcgcggcgcctgcggcggcgaacggacggacggaccgcggacggacgtactgaccccaacccgcgagccccgggagccgtcggtctgaggaggggccgcttcgccatgtcgccccgcacctgctgagcccggagcgtccgaggatgtccgcgctgaggaaggtgcgagccgccgggggctgccgggagccgggcgcggggctccgagagccgtcgaggcggggagggcgcggtgtgtcggacccgcggggacgccccgagggcgtcagggttgggggcgggggcgagcgggggtcgtgccgcccgccggggccggagcgctggggaccccagggacagcctgtgctcgggggtcgcgcgttgcgctcctcgccgggctccgcgcatccctggccgcgctcgggggtgccgggaccctgggctccgggggtgcgggagcgcacggggccgcggaggtgtgaaattctccgctctgcctgcccggggtggagggggcaaagcctggggggtgccggcgcgccaggggctacgcgcctagctccggtggggcagctgcgagcgagtgggggcggcgggcagcagactgcatccccctccccccaagcccgggtggaaacgccgacggggactgggaatgaatgaagggtgccgggctgggctgcgcgcacgggggctcgcgggggcgggggcgaccaggatggggcccttgtgccgggcagcagcggctgccgagaccaggcggagtggagggtgcgcgcagcgagggggtggccgccgcccggctctccaagtgcgagcgaggagctcggggtcttttttaggggtggttgctaagcgaggcgctacccagcgcagggttttgtaactaagcctcccccggcagcggctgttgctgtctccggctccttcgctaacgattgcaggagaaataatgaggatgtaattattacagccctgcgcggagggctggggggcggcggacgcgggctcctctgcctgcgcgcccaggtggggctgggctgggctgggctgggctgggctggactggacgcctctccccgcccggccctccctcagcgcgcggcgtgtgcggtgcccgaggcttcggagcaggctggacctgggaacccggggaggggcctggaggagagatagctgggcgaggtgggcgccggcgagaaggcggagcccccggacagcgtaggttcgcaggtggagagcggacgcgggggcgagggtgcgcggcgggtctgcgatgcgcgtcggaaactcgcggcccccggtcccggccctgcgcgcttggagcccgggtccttccagcccctgcgcgacgccgccgccgccgccgccggtgaatggcgatcccggccacggcctggaattggaaattcgtgacttgtcggcggccccggtcttctatcgattaaagataaagcgatcagcagtgaatttatccttcgtgtggatgaactcggccagcccgggctgtggggggtttgggaactgtaaatattctccaaagcgccgccgcttctcccgtcttcccggactcgaggctggaggcagctccggcgacgcgaaggggggtaccccccggagaggtcgggcctggggcgcggcggacagagacccggtcccagagcctggcggagcccgacaatccgccctgtcaggaggaatctcatcaacagcccgtgaattaattgtccttgcagttgggaaataacccggtacctcggcgta

SEQ ID NO: 128895 - DNA, 30 bp, Homo sapiens; identical to SEQ ID NO: 41650
  chr8:700159-700189
  Hypo

SEQ ID NO: 128896 - DNA, 30 bp, Homo sapiens; identical to SEQ ID NO: 99817
  chr8:751817-751847
  Hypo

SEQ ID NO: 128897 - DNA, 30 bp, Homo sapiens; identical to SEQ ID NO: 99841
  chr8:787176-787206
  Hypo

SEQ ID NO: 128898 - DNA, 93 bp, Homo sapiens; identical to SEQ ID NO: 99842
  chr8:790385-790478
  Hypo

SEQ ID NO: 128899 - DNA, 145 bp, Homo sapiens; identical to SEQ ID NO: 99880
  chr8:852161-852306
  Hypo

SEQ ID NO: 128900 - DNA, 134 bp, Homo sapiens; identical to SEQ ID NO: 99881
  chr8:853984-854118
  Hypo

SEQ ID NO: 128901 - DNA, 105 bp, Homo sapiens; identical to SEQ ID NO: 99882
  chr8:854712-854817
  Hypo

SEQ ID NO: 128902 - DNA, 30 bp, Homo sapiens; identical to SEQ ID NO: 99903
  chr8:865633-865663
  Hypo

SEQ ID NO: 128903 - DNA, 46 bp, Homo sapiens; identical to SEQ ID NO: 99917
  chr8:889984-890030
  Hypo

SEQ ID NO: 128904 - DNA, 32 bp, Homo sapiens; identical to SEQ ID NO: 99923
  chr8:898037-898069
  Hypo

SEQ ID NO: 128905 - DNA, 30 bp, Homo sapiens; identical to SEQ ID NO: 99935
  chr8:913030-913060
  Hypo

SEQ ID NO: 128906 - DNA, 30 bp, Homo sapiens; identical to SEQ ID NO: 99938
  chr8:914330-914360
  Hypo

SEQ ID NO: 128907 - DNA, 29 bp, Homo sapiens
  chr8:914936-914965
  Hypo
tcgccaccgcacacacggctcctgagccc

SEQ ID NO: 128908 - DNA, 78 bp, Homo sapiens; identical to SEQ ID NO: 99967
  chr8:956346-956424
  Hypo

SEQ ID NO: 128909 - DNA, 33 bp, Homo sapiens; identical to SEQ ID NO: 99975
  chr8:957089-957122
  Hypo

SEQ ID NO: 128910 - DNA, 137 bp, Homo sapiens; identical to SEQ ID NO: 99984
  chr8:962438-962575
  Hypo

SEQ ID NO: 128911 - DNA, 30 bp, Homo sapiens; identical to SEQ ID NO: 100009
  chr8:972233-972263
  Hypo

SEQ ID NO: 128912 - DNA, 145 bp, Homo sapiens; identical to SEQ ID NO: 41655
  chr8:972705-972850
  Hypo

SEQ ID NO: 128913 - DNA, 30 bp, Homo sapiens; identical to SEQ ID NO: 100019
  chr8:975257-975287
  Hypo

SEQ ID NO: 128914 - DNA, 126 bp, Homo sapiens; identical to SEQ ID NO: 41656
  chr8:976259-976385
  Hypo

SEQ ID NO: 128915 - DNA, 180 bp, Homo sapiens; identical to SEQ ID NO: 100031
  chr8:977877-978057
  Hypo

SEQ ID NO: 128916 - DNA, 30 bp, Homo sapiens; identical to SEQ ID NO: 100039
  chr8:987146-987176
  Hypo

SEQ ID NO: 128917 - DNA, 44 bp, Homo sapiens; identical to SEQ ID NO: 98319
  chr8:1000543-1000587
  Hypo

SEQ ID NO: 128918 - DNA, 30 bp, Homo sapiens; identical to SEQ ID NO: 98328
  chr8:1010325-1010355
  Hypo

SEQ ID NO: 128919 - DNA, 207 bp, Homo sapiens; identical to SEQ ID NO: 98372
  chr8:1043858-1044065
  Hypo

SEQ ID NO: 128920 - DNA, 246 bp, Homo sapiens; identical to SEQ ID NO: 98377
  chr8:1048526-1048772
  Hypo

SEQ ID NO: 128921 - DNA, 140 bp, Homo sapiens; identical to SEQ ID NO: 98379
  chr8:1051534-1051674
  Hypo

SEQ ID NO: 128922 - DNA, 30 bp, Homo sapiens; identical to SEQ ID NO: 98384
  chr8:1053744-1053774
  Hypo

SEQ ID NO: 128923 - DNA, 41 bp, Homo sapiens; identical to SEQ ID NO: 98404
  chr8:1060967-1061008
  Hypo

SEQ ID NO: 128924 - DNA, 53 bp, Homo sapiens; identical to SEQ ID NO: 41660
  chr8:1066123-1066176
  Hypo

SEQ ID NO: 128925 - DNA, 50 bp, Homo sapiens; identical to SEQ ID NO: 98430
  chr8:1085553-1085603
  Hypo

SEQ ID NO: 128926 - DNA, 30 bp, Homo sapiens; identical to SEQ ID NO: 98443
  chr8:1088028-1088058
  Hypo

SEQ ID NO: 128927 - DNA, 30 bp, Homo sapiens; identical to SEQ ID NO: 98471
  chr8:1108569-1108599
  Hypo

SEQ ID NO: 128928 - DNA, 43 bp, Homo sapiens; identical to SEQ ID NO: 98492
  chr8:1133089-1133132
  Hypo

SEQ ID NO: 128929 - DNA, 30 bp, Homo sapiens; identical to SEQ ID NO: 98493
  chr8:1134528-1134558
  Hypo

SEQ ID NO: 128930 - DNA, 56 bp, Homo sapiens; identical to SEQ ID NO: 98494
  chr8:1136167-1136223
  Hypo

SEQ ID NO: 128931 - DNA, 30 bp, Homo sapiens; identical to SEQ ID NO: 98495
  chr8:1136428-1136458
  Hypo

SEQ ID NO: 128932 - DNA, 139 bp, Homo sapiens; identical to SEQ ID NO: 98496
  chr8:1137213-1137352
  Hypo

SEQ ID NO: 128933 - DNA, 112 bp, Homo sapiens; identical to SEQ ID NO: 98497
  chr8:1139159-1139271
  Hypo

SEQ ID NO: 128934 - DNA, 37 bp, Homo sapiens; identical to SEQ ID NO: 98498
  chr8:1140563-1140600
  Hypo

SEQ ID NO: 128935 - DNA, 30 bp, Homo sapiens; identical to SEQ ID NO: 98507
  chr8:1148027-1148057
  Hypo

SEQ ID NO: 128936 - DNA, 95 bp, Homo sapiens; identical to SEQ ID NO: 98510
  chr8:1151094-1151189
  Hypo

SEQ ID NO: 128937 - DNA, 136 bp, Homo sapiens; identical to SEQ ID NO: 98511
  chr8:1152943-1153079
  Hypo

SEQ ID NO: 128938 - DNA, 118 bp, Homo sapiens; identical to SEQ ID NO: 41667
  chr8:1153298-1153416
  Hypo

SEQ ID NO: 128939 - DNA, 172 bp, Homo sapiens; identical to SEQ ID NO: 98547
  chr8:1184672-1184844
  Hypo

SEQ ID NO: 128940 - DNA, 300 bp, Homo sapiens; identical to SEQ ID NO: 98551
  chr8:1201984-1202284
  Hypo

SEQ ID NO: 128941 - DNA, 144 bp, Homo sapiens; identical to SEQ ID NO: 98553
  chr8:1202638-1202782
  Hypo

SEQ ID NO: 128942 - DNA, 30 bp, Homo sapiens; identical to SEQ ID NO: 98555
  chr8:1203228-1203258
  Hypo

SEQ ID NO: 128943 - DNA, 30 bp, Homo sapiens; identical to SEQ ID NO: 98559
  chr8:1204827-1204857
  Hypo

SEQ ID NO: 128944 - DNA, 198 bp, Homo sapiens; identical to SEQ ID NO: 98565
  chr8:1209060-1209258
  Hypo

SEQ ID NO: 128945 - DNA, 30 bp, Homo sapiens; identical to SEQ ID NO: 98585
  chr8:1219311-1219341
  Hypo

SEQ ID NO: 128946 - DNA, 447 bp, Homo sapiens; identical to SEQ ID NO: 98608
  chr8:1246426-1246873
  Hypo

SEQ ID NO: 128947 - DNA, 30 bp, Homo sapiens; identical to SEQ ID NO: 98610
  chr8:1251266-1251296
  Hypo

SEQ ID NO: 128948 - DNA, 70 bp, Homo sapiens; identical to SEQ ID NO: 98611
  chr8:1251700-1251770
  Hypo

SEQ ID NO: 128949 - DNA, 385 bp, Homo sapiens; identical to SEQ ID NO: 98632
  chr8:1269154-1269539
  Hypo

SEQ ID NO: 128950 - DNA, 112 bp, Homo sapiens; identical to SEQ ID NO: 98636
  chr8:1276830-1276942
  Hypo

SEQ ID NO: 128951 - DNA, 30 bp, Homo sapiens; identical to SEQ ID NO: 98638
  chr8:1279525-1279555
  Hypo

SEQ ID NO: 128952 - DNA, 42 bp, Homo sapiens; identical to SEQ ID NO: 41671
  chr8:1281668-1281710
  Hypo

SEQ ID NO: 128953 - DNA, 45 bp, Homo sapiens; identical to SEQ ID NO: 98644
  chr8:1284619-1284664
  Hypo

SEQ ID NO: 128954 - DNA, 30 bp, Homo sapiens; identical to SEQ ID NO: 98654
  chr8:1290508-1290538
  Hypo

SEQ ID NO: 128955 - DNA, 162 bp, Homo sapiens; identical to SEQ ID NO: 98667
  chr8:1302664-1302826
  Hypo

SEQ ID NO: 128956 - DNA, 30 bp, Homo sapiens; identical to SEQ ID NO: 41673
  chr8:1303386-1303416
  Hypo

SEQ ID NO: 128957 - DNA, 30 bp, Homo sapiens; identical to SEQ ID NO: 98675
  chr8:1305031-1305061
  Hypo

SEQ ID NO: 128958 - DNA, 75 bp, Homo sapiens; identical to SEQ ID NO: 98677
  chr8:1306799-1306874
  Hypo

SEQ ID NO: 128959 - DNA, 142 bp, Homo sapiens; identical to SEQ ID NO: 98678
  chr8:1307773-1307915
  Hypo

SEQ ID NO: 128960 - DNA, 47 bp, Homo sapiens; identical to SEQ ID NO: 98679
  chr8:1308321-1308368
  Hypo

SEQ ID NO: 128961 - DNA, 30 bp, Homo sapiens; identical to SEQ ID NO: 98691
  chr8:1326091-1326121
  Hypo

SEQ ID NO: 128962 - DNA, 52 bp, Homo sapiens; identical to SEQ ID NO: 98692
  chr8:1326776-1326828
  Hypo

SEQ ID NO: 128963 - DNA, 30 bp, Homo sapiens; identical to SEQ ID NO: 98693
  chr8:1327435-1327465
  Hypo

SEQ ID NO: 128964 - DNA, 30 bp, Homo sapiens; identical to SEQ ID NO: 41675
  chr8:1340176-1340206
  Hypo

SEQ ID NO: 128965 - DNA, 89 bp, Homo sapiens; identical to SEQ ID NO: 98732
  chr8:1362767-1362856
  Hypo

SEQ ID NO: 128966 - DNA, 160 bp, Homo sapiens; identical to SEQ ID NO: 98739
  chr8:1380012-1380172
  Hypo

SEQ ID NO: 128967 - DNA, 30 bp, Homo sapiens; identical to SEQ ID NO: 98753
  chr8:1400681-1400711
  Hypo

SEQ ID NO: 128968 - DNA, 123 bp, Homo sapiens; identical to SEQ ID NO: 98808
  chr8:1420309-1420432
  Hypo

SEQ ID NO: 128969 - DNA, 188 bp, Homo sapiens; identical to SEQ ID NO: 98826
  chr8:1423661-1423849
  Hypo

SEQ ID NO: 128970 - DNA, 30 bp, Homo sapiens; identical to SEQ ID NO: 98968
  chr8:1438482-1438512
  Hypo

SEQ ID NO: 128971 - DNA, 55 bp, Homo sapiens; identical to SEQ ID NO: 99025
  chr8:1443699-1443754
  Hypo

SEQ ID NO: 128972 - DNA, 30 bp, Homo sapiens; identical to SEQ ID NO: 99098
  chr8:1463086-1463116
  Hypo

SEQ ID NO: 128973 - DNA, 183 bp, Homo sapiens; identical to SEQ ID NO: 99099
  chr8:1471481-1471664
  Hypo

SEQ ID NO: 128974 - DNA, 84 bp, Homo sapiens; identical to SEQ ID NO: 99101
  chr8:1501600-1501684
  Hypo

SEQ ID NO: 128975 - DNA, 30 bp, Homo sapiens; identical to SEQ ID NO: 99102
  chr8:1507113-1507143
  Hypo

SEQ ID NO: 128976 - DNA, 39 bp, Homo sapiens; identical to SEQ ID NO: 99109
  chr8:1569815-1569854
  Hypo

SEQ ID NO: 128977 - DNA, 30 bp, Homo sapiens; identical to SEQ ID NO: 99110
  chr8:1574119-1574149
  Hypo

SEQ ID NO: 128978 - DNA, 162 bp, Homo sapiens; identical to SEQ ID NO: 99111
  chr8:1574846-1575008
  Hypo

SEQ ID NO: 128979 - DNA, 39 bp, Homo sapiens; identical to SEQ ID NO: 99112
  chr8:1579143-1579182
  Hypo

SEQ ID NO: 128980 - DNA, 87 bp, Homo sapiens; identical to SEQ ID NO: 99113
  chr8:1581006-1581093
  Hypo

SEQ ID NO: 128981 - DNA, 301 bp, Homo sapiens; identical to SEQ ID NO: 99114
  chr8:1588688-1588989
  Hypo

SEQ ID NO: 128982 - DNA, 87 bp, Homo sapiens; identical to SEQ ID NO: 99115
  chr8:1592418-1592505
  Hypo

SEQ ID NO: 128983 - DNA, 90 bp, Homo sapiens; identical to SEQ ID NO: 99116
  chr8:1613724-1613814
  Hypo

SEQ ID NO: 128984 - DNA, 51 bp, Homo sapiens; identical to SEQ ID NO: 99117
  chr8:1616193-1616244
  Hypo

SEQ ID NO: 128985 - DNA, 38 bp, Homo sapiens; identical to SEQ ID NO: 41686
  chr8:1645305-1645343
  Hypo

SEQ ID NO: 128986 - DNA, 30 bp, Homo sapiens; identical to SEQ ID NO: 99130
  chr8:1771721-1771751
  Hyper

SEQ ID NO: 128987 - DNA, 495 bp, Homo sapiens; identical to SEQ ID NO: 99131
  chr8:1772198-1772693
  Hyper

SEQ ID NO: 128988 - DNA, 139 bp, Homo sapiens; identical to SEQ ID NO: 99132
  chr8:1778994-1779133
  Hypo

SEQ ID NO: 128989 - DNA, 38 bp, Homo sapiens; identical to SEQ ID NO: 99133
  chr8:1784057-1784095
  Hypo

SEQ ID NO: 128990 - DNA, 30 bp, Homo sapiens; identical to SEQ ID NO: 99136
  chr8:1811759-1811789
  Hypo

SEQ ID NO: 128991 - DNA, 32 bp, Homo sapiens; identical to SEQ ID NO: 99138
  chr8:1857610-1857642
  Hypo

SEQ ID NO: 128992 - DNA, 30 bp, Homo sapiens; identical to SEQ ID NO: 99144
  chr8:1921312-1921342
  Hyper

SEQ ID NO: 128993 - DNA, 35 bp, Homo sapiens; identical to SEQ ID NO: 99145
  chr8:1921544-1921579
  Hyper

SEQ ID NO: 128994 - DNA, 74 bp, Homo sapiens; identical to SEQ ID NO: 99146
  chr8:1922587-1922661
  Hyper

SEQ ID NO: 128995 - DNA, 44 bp, Homo sapiens; identical to SEQ ID NO: 99236
  chr8:2536006-2536050
  Hypo

SEQ ID NO: 128996 - DNA, 30 bp, Homo sapiens; identical to SEQ ID NO: 99237
  chr8:2537563-2537593
  Hypo

SEQ ID NO: 128997 - DNA, 34 bp, Homo sapiens; identical to SEQ ID NO: 99238
  chr8:2538299-2538333
  Hypo

SEQ ID NO: 128998 - DNA, 56 bp, Homo sapiens; identical to SEQ ID NO: 41689
  chr8:2652772-2652828
  Hypo

SEQ ID NO: 128999 - DNA, 87 bp, Homo sapiens; identical to SEQ ID NO: 99299
  chr8:3036403-3036490
  Hypo

SEQ ID NO: 129000 - DNA, 148 bp, Homo sapiens; identical to SEQ ID NO: 99300
  chr8:3040630-3040778
  Hypo

SEQ ID NO: 129001 - DNA, 30 bp, Homo sapiens; identical to SEQ ID NO: 99317
  chr8:3245048-3245078
  Hypo

SEQ ID NO: 129002 - DNA, 44 bp, Homo sapiens; identical to SEQ ID NO: 99336
  chr8:3769055-3769099
  Hypo

SEQ ID NO: 129003 - DNA, 37 bp, Homo sapiens; identical to SEQ ID NO: 99438
  chr8:4671648-4671685
  Hypo

SEQ ID NO: 129004 - DNA, 783 bp, Homo sapiens
  chr8:4849052-4849835
  Hyper
gcgggagccgccacccgggcgcgcgcggcgcagctgcccacggcagtggccgggcgccctcctgccggagcgctcctccccgggaaagccctgctgcttgcaagcgcctccggtgggccctggagcgcgctgccgagccccggggcccagcgccgacgcccccggggggaggcccgaccttggtcacccgggctttgctaggcaaggggaacgcgacgccgccccaatggccagagcgcacaaacggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccacccgcgtgggggcggaatccgcccggcacacacgtgtgcggattatt

SEQ ID NO: 129005 - DNA, 467 bp, Homo sapiens
  chr8:4850232-4850699
  Hyper
gccctgctcagcaggcgctgcctccgcagccggcaatgtcagaggcaccggccaaggcatccggactgagccgggcgggtgggcagagggtcggcgtctgcaagaagctccccagtcccgagcgaccacgagcttgggtgactaagacccactgtttgcgatccccgagatctcggggcgcattcccgcagacacccccttgtgagggtggatgccggtgaggaggagctggtgctgagcggtcagctttcacggagccctggacgccccgtggaggcaagtgcagggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatg

SEQ ID NO: 129006 - DNA, 33 bp, Homo sapiens; identical to SEQ ID NO: 31747
  chr8:4851342-4851375
  Hyper

SEQ ID NO: 129007 - DNA, 30 bp, Homo sapiens; identical to SEQ ID NO: 31748
  chr8:4851581-4851611
  Hyper

SEQ ID NO: 129008 - DNA, 774 bp, Homo sapiens; identical to SEQ ID NO: 99464
  chr8:4851814-4852588
  Hyper

SEQ ID NO: 129009 - DNA, 30 bp, Homo sapiens; identical to SEQ ID NO: 99515
  chr8:5347789-5347819
  Hypo

SEQ ID NO: 129010 - DNA, 28 bp, Homo sapiens
  chr8:5949415-5949443
  Hypo
gatcggcaaactccgtcttttctatccg

SEQ ID NO: 129011 - DNA, 25 bp, Homo sapiens
  chr8:6063181-6063206
  Hypo
aaaaataagacgatgaacaaggatc

SEQ ID NO: 129012 - DNA, 30 bp, Homo sapiens; identical to SEQ ID NO: 99633
  chr8:6072853-6072883
  Hypo

SEQ ID NO: 129013 - DNA, 121 bp, Homo sapiens; identical to SEQ ID NO: 99634
  chr8:6118678-6118799
  Hypo

SEQ ID NO: 129014 - DNA, 210 bp, Homo sapiens; identical to SEQ ID NO: 99659
  chr8:6434302-6434512
  Hypo

SEQ ID NO: 129015 - DNA, 30 bp, Homo sapiens; identical to SEQ ID NO: 99665
  chr8:6526266-6526296
  Hypo

SEQ ID NO: 129016 - DNA, 30 bp, Homo sapiens; identical to SEQ ID NO: 41694
  chr8:6542607-6542637
  Hypo

SEQ ID NO: 129017 - DNA, 30 bp, Homo sapiens; identical to SEQ ID NO: 99705
  chr8:6637553-6637583
  Hypo

SEQ ID NO: 129018 - DNA, 79 bp, Homo sapiens; identical to SEQ ID NO: 99710
  chr8:6663499-6663578
  Hypo

SEQ ID NO: 129019 - DNA, 411 bp, Homo sapiens; identical to SEQ ID NO: 99711
  chr8:6692051-6692462
  Hyper

SEQ ID NO: 129020 - DNA, 484 bp, Homo sapiens; identical to SEQ ID NO: 99712
  chr8:6692686-6693170
  Hyper

SEQ ID NO: 129021 - DNA, 21 bp, Homo sapiens
  chr8:6774704-6774725
  Hypo
ttcattttggctgggcgcggt

SEQ ID NO: 129022 - DNA, 87 bp, Homo sapiens; identical to SEQ ID NO: 99754
  chr8:6932550-6932637
  Hypo

SEQ ID NO: 129023 - DNA, 151 bp, Homo sapiens; identical to SEQ ID NO: 99755
  chr8:6940557-6940708
  Hypo

SEQ ID NO: 129024 - DNA, 62 bp, Homo sapiens
  chr8:8559755-8559817
  Hyper
cagggctcaggagcccgacccggagcccggggcgtccgcgctgacttcgggtccccggagcc

SEQ ID NO: 129025 - DNA, 236 bp, Homo sapiens; identical to SEQ ID NO: 99883
  chr8:8560796-8561032
  Hypo

SEQ ID NO: 129026 - DNA, 360 bp, Homo sapiens; identical to SEQ ID NO: 99890
  chr8:8639440-8639800
  Hypo

SEQ ID NO: 129027 - DNA, 120 bp, Homo sapiens; identical to SEQ ID NO: 99891
  chr8:8639860-8639980
  Hypo

SEQ ID NO: 129028 - DNA, 75 bp, Homo sapiens; identical to SEQ ID NO: 99904
  chr8:8666327-8666402
  Hypo

SEQ ID NO: 129029 - DNA, 30 bp, Homo sapiens; identical to SEQ ID NO: 99911
  chr8:8709733-8709763
  Hypo

SEQ ID NO: 129030 - DNA, 738 bp, Homo sapiens; identical to SEQ ID NO: 99912
  chr8:8748350-8749088
  Hypo

SEQ ID NO: 129031 - DNA, 30 bp, Homo sapiens; identical to SEQ ID NO: 41699
  chr8:8898369-8898399
  Hypo

SEQ ID NO: 129032 - DNA, 30 bp, Homo sapiens; identical to SEQ ID NO: 41700
  chr8:8898687-8898717
  Hypo

SEQ ID NO: 129033 - DNA, 30 bp, Homo sapiens; identical to SEQ ID NO: 99986
  chr8:9638573-9638603
  Hypo

SEQ ID NO: 129034 - DNA, 165 bp, Homo sapiens; identical to SEQ ID NO: 99989
  chr8:9686554-9686719
  Hypo

SEQ ID NO: 129035 - DNA, 46 bp, Homo sapiens; identical to SEQ ID NO: 100010
  chr8:9722850-9722896
  Hypo

SEQ ID NO: 129036 - DNA, 30 bp, Homo sapiens; identical to SEQ ID NO: 100018
  chr8:9751525-9751555
  Hypo

SEQ ID NO: 129037 - DNA, 547 bp, Homo sapiens
  chr8:9755968-9756515
  Hyper
tgcccgctccctggccgggtcactgggggtatccgggagaggaggctggatgtatgggcggggcgtcctaatggggaatccaggaggatgcactgagacggaccccccactccagcaaataaaacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggccgggagggcgcggcttctaggcccaggcctgcggctggggagcgctgtgggtggccaggggaggacgtgacctcccgcccaggccttcggtctggctcggccacccttggaagcaaaggatgtaccctcgtctcaattcgtcccgcttcctgcccccgactccggaaaaatctctaacgttgaccgtcgagtgtccatctggcgctagagtgaaatcgatgtgcatggaaa

SEQ ID NO: 129038 - DNA, 420 bp, Homo sapiens; identical to SEQ ID NO: 100022
  chr8:9760735-9761155
  Hyper

SEQ ID NO: 129039 - DNA, 324 bp, Homo sapiens; identical to SEQ ID NO: 100023
  chr8:9761415-9761739
  Hyper

SEQ ID NO: 129040 - DNA, 504 bp, Homo sapiens; identical to SEQ ID NO: 100024
  chr8:9761799-9762303
  Hyper

SEQ ID NO: 129041 - DNA, 2500 bp, Homo sapiens
  chr8:9762586-9765086
  Hyper
agaccccaacaaccccgacccctctcctacgtagacactgtgaaagcaagccacagggacaaataaaagacaatccgaataccctcagcgttccgcacgccgggcggacgcccttccgcagcggccacgcgtgttctgggttcagcgctcctgcgcgtcccttctcgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaaatccagcccttcgcgtgaactcgcgtcgagcgcggattgcaggggatgaggaagaagggggaggggaggggagggtggaggagggagggggaggggtagaggggaaggcagagagggacagagagaattgggagccttttaatttttccttaccaagccctaatctcgtgcgccgtcctctttggctgaggtcgagctcctttttaaaaattattactcctttaaaggattattcaggtaaaggaagccgcatctgctgacggttccgaaaacaagaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtggcgattcgcacccccacactcacacgcgcttccgtttatccgtttctatcccgggaaaagggggcgcctgcccgagcccacgcgcgccgccgcatctgcagcggtcggcgccccacgctccctgaacgccccccaggcggcaccagtgccgggcagagtcccctcggcggccgcgggcgtcaaatcgacacctgactccacagctcccttccctctcctcttcttccacctccccgggggtccaggcaccgccgtgcgtccactcccggtctccacggcttaggcagacggagtgggggactccggggacccgcgcgtcctctcctcctcggccctggcgggaggagccgggctggggtttccgcgggccgcggcgcgttttagggctgccggggactgcggcggatgcggttgacatcactgcggcggctgccgggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcagaggcgcccacccagcaggagtggctgcacgaagggtgacccgggcgaggcccttctcgcttcgaggccatttcggctcttgtcaattattgggtgtttgtcccaatataagtagaatggcgatctcaaaccctt

SEQ ID NO: 129042 - DNA, 30 bp, Homo sapiens; identical to SEQ ID NO: 100051
  chr8:9993158-9993188
  Hypo

SEQ ID NO: 129043 - DNA, 159 bp, Homo sapiens; identical to SEQ ID NO: 98318
  chr8:10005422-10005581
  Hypo

SEQ ID NO: 129044 - DNA, 35 bp, Homo sapiens; identical to SEQ ID NO: 98320
  chr8:10019317-10019352
  Hypo

SEQ ID NO: 129045 - DNA, 156 bp, Homo sapiens; identical to SEQ ID NO: 98321
  chr8:10022508-10022664
  Hypo

SEQ ID NO: 129046 - DNA, 78 bp, Homo sapiens; identical to SEQ ID NO: 98347
  chr8:10192879-10192957
  Hypo

SEQ ID NO: 129047 - DNA, 75 bp, Homo sapiens; identical to SEQ ID NO: 98350
  chr8:10210850-10210925
  Hypo

SEQ ID NO: 129048 - DNA, 100 bp, Homo sapiens; identical to SEQ ID NO: 98352
  chr8:10218064-10218164
  Hypo

SEQ ID NO: 129049 - DNA, 39 bp, Homo sapiens; identical to SEQ ID NO: 98353
  chr8:10224220-10224259
  Hypo

SEQ ID NO: 129050 - DNA, 30 bp, Homo sapiens; identical to SEQ ID NO: 98354
  chr8:10248245-10248275
  Hypo

SEQ ID NO: 129051 - DNA, 148 bp, Homo sapiens; identical to SEQ ID NO: 98359
  chr8:10261838-10261986
  Hypo

SEQ ID NO: 129052 - DNA, 84 bp, Homo sapiens; identical to SEQ ID NO: 98378
  chr8:10509949-10510033
  Hypo

SEQ ID NO: 129053 - DNA, 142 bp, Homo sapiens; identical to SEQ ID NO: 41704
  chr8:10528983-10529125
  Hypo

SEQ ID NO: 129054 - DNA, 77 bp, Homo sapiens; identical to SEQ ID NO: 98390
  chr8:10548185-10548262
  Hypo

SEQ ID NO: 129055 - DNA, 165 bp, Homo sapiens; identical to SEQ ID NO: 98395
  chr8:10562094-10562259
  Hypo

SEQ ID NO: 129056 - DNA, 1245 bp, Homo sapiens
  chr8:10587422-10588667
  Hyper
ccccgccccctggggcgccgatctccgctcctgtcccagcagaggagcctccctgcccgccgcgcggtttcactttggaccgcgccaagtgcccccgctctgaatcctgggcaccgcgagcacccacgctcgcgcagatggccagccacgcgggcacgaagagggccctcgtcccgcgtgccgggtcttccccaggctccgcgctcgcacccgccctgcagtgccgccagccgcccgccgcccgcccccggcccccagcccgctcggccgcgcgctcactcacccagcatcttgctgagctcggcgttgtgcaggtccgggttctgcactgccagccgtttcctctcgtccttggcccaaaccatgaaggcgttcatgggccgccggatacggctctcggagcccttgtcccccgggggccgggggacggccggcggcgattgtccatccgacagctcggcgtccagggccgggcactcgagaccctcgggccaagggtaggctcccagcagcgaagccatggccgcacgcgggtcgcctcgcttcgcctggcggggcaggcgcggacctggccctcgcacgggtcggggcgtccaacttggcccgcagccgcgacccggcccctgatttatcagcttcgggcggccgcgtcctccaatgactctccaaggcggcgcggcccctccctcggtgtcggcgcgggtcccctccctgcgtcccgggccgccgccgggtccccgctccgacctgccgggaggaggacggagggagggagtgagggagggcctcctccccgcgcctgcccccggcccgcccctccgccgccagggcccgcccggggatctgcgcccggctgccccgggccgcctcccgccccctgccctggacccgcaggtgccgcagagacgcaaggcaggcgctggaggcccgctccagcccctgcctgcccgggccagactccaccgccctccctgcgcgtgtggcctcagaaaatcaacccaaccaggtttcgccgagcccgcctgggtgtgagagacattgaccatgaacccctcagagcagccgttcttaatactccgactgccattcctttcgaaaatgaccgggcttcggccaccgcagccccagtcaacttgggccgccacagaggccggccggagccggggctgggggccgcatcccgcctcgggttctgtgcagtgctcacccaagacccctcgacgcccccgccgcccctggctctca

SEQ ID NO: 129057 - DNA, 78 bp, Homo sapiens; identical to SEQ ID NO: 98402
  chr8:10590855-10590933
  Hyper

SEQ ID NO: 129058 - DNA, 56 bp, Homo sapiens; identical to SEQ ID NO: 98417
  chr8:10694858-10694914
  Hypo

SEQ ID NO: 129059 - DNA, 30 bp, Homo sapiens
  chr8:10708309-10708339
  Hyper
ggcggtgggcgggggcggcggggaacaacg

SEQ ID NO: 129060 - DNA, 208 bp, Homo sapiens; identical to SEQ ID NO: 98439
  chr8:10873441-10873649
  Hyper

SEQ ID NO: 129061 - DNA, 153 bp, Homo sapiens; identical to SEQ ID NO: 98440
  chr8:10873889-10874042
  Hyper

SEQ ID NO: 129062 - DNA, 30 bp, Homo sapiens; identical to SEQ ID NO: 98441
  chr8:10874300-10874330
  Hyper

SEQ ID NO: 129063 - DNA, 255 bp, Homo sapiens; identical to SEQ ID NO: 98451
  chr8:10916999-10917254
  Hyper

SEQ ID NO: 129064 - DNA, 30 bp, Homo sapiens; identical to SEQ ID NO: 98453
  chr8:10928999-10929029
  Hypo

SEQ ID NO: 129065 - DNA, 30 bp, Homo sapiens; identical to SEQ ID NO: 98455
  chr8:10959729-10959759
  Hypo

SEQ ID NO: 129066 - DNA, 57 bp, Homo sapiens; identical to SEQ ID NO: 98456
  chr8:10966208-10966265
  Hypo

SEQ ID NO: 129067 - DNA, 34 bp, Homo sapiens; identical to SEQ ID NO: 98463
  chr8:11049928-11049962
  Hypo

SEQ ID NO: 129068 - DNA, 33 bp, Homo sapiens; identical to SEQ ID NO: 98464
  chr8:11053392-11053425
  Hypo

SEQ ID NO: 129069 - DNA, 647 bp, Homo sapiens
  chr8:11058152-11058799
  Hyper
gcgctgcgcccccggcgtgggggagaccctcacgcctgggccaccgcgggccgcgccgtggacgtagccggcccccatcatgggggggccccggctggtgagcccctccacggcgcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggggccgcgggaggctgcagcggctggtcccccccgtcggcggcggcgctgcggcgcggcttcctgcccaggagggagcgcaggcaggcggagcggcagccccagtagcacgaggaggtgttgcagcagtggcagatgtgcatcgagctgctctcgccgggctcgctgccgtcgccgccgccgccgcagccgcctcccccgggctccccgtcctcctcgccgccgctgcccaccgcctcgtccaggttgtgca

SEQ ID NO: 129070 - DNA, 1223 bp, Homo sapiens
  chr8:11204479-11205702
  Hyper
gattgcaatatgcagcggagtttgagaaccagcgccttggacccagcttcttaagctactgcgcgcaccggcgtcccgctgggggcgcgcgagccccacccccagagatgctgactcagcaagtcgggaggggttgggggtgggacctgccaatctgcatttccaaccggcgcccaggtgacgctgactctgctggtctaccgtcttgggggtcacctaatttttcagcgatgcctcccagctggggaggccaagaagtgcctcgctcaaggtcttccaacacccgacctccagaccctcaatcctgggccagctacaccgcaaacctttccagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgcgggcagctccaactctgggttcgtagtttgcgctgggtgcgcaggaaggtcagtgtgggggtcgcccgacatttcccccccgcggaggtgggagccgagccacatcttggagtggggactggccgcggagcgggttgcccagggccggccgaggtcggggcgagccctgcgcggcgctggagactctgcattcccgggcgcgcgcagggtccccggccgtggtcgcagagtcaggaggggcggctccggagcccggcgcggggagggcccaggcgcagtcggggttggcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccggtctgcagtcaga

SEQ ID NO: 129071 - DNA, 61 bp, Homo sapiens; identical to SEQ ID NO: 9392
  chr8:11206007-11206068
  Hyper

SEQ ID NO: 129072 - DNA, 218 bp, Homo sapiens; identical to SEQ ID NO: 98487
  chr8:11302089-11302307
  Hypo

SEQ ID NO: 129073 - DNA, 478 bp, Homo sapiens
  chr8:11536805-11537283
  Hyper
gaaggttctcagactcggggatgggggaggaaggggacgtttctagaagaaacttaaagggggctcgcgccgcacgactgtaggtggagggcgtgcgccgcgggacgccccagccgggtctgataaagccccgaagccgatctaaggtcaataaaccaggcggcgtcaggcttgggccgagggccgggaggagaggagagtggagccctctcaggctggcggcggaatgaaaaggaaccccgactgctggggtccgagccctgggccgcttgcggggcgcgcagccggggagaggagctgggcgcgcggcctgggccccccacctgcccgaccccagggcagccaagcacccgcggccttaaaagtatcccggcgagccctgagtgggccgggtgctgggcgaacagtcctagccctgcactgaggttggaaaagcgaacggaaagtgacatttttacaggggcgaggttgggatcgg

SEQ ID NO: 129074 - DNA, 381 bp, Homo sapiens
  chr8:11537839-11538220
  Hyper
aacgggccctggagccggggaatctctgcaagtaactaaccaggcccctcggattcattgccactttcccgccctcggcccacgaggctgaggagctccctctcatcgcctctccgttcctggcaaggccgaagccggtttgctttggatgcatttcgatcaatctggcgccacatgggccaggtcacctcggacgggtgtcgcgccgacgtccttcgtggtcgcacgctggtgggccaggaagcccaggctatgcccagccgggtccgagcggcggtcggtggcgtgacctcttgccacgcctggcgctgctgggaacgtgtctcgggtcgccctttgcgtcagagaccccccccttggggagaccggaatcctccagcc

SEQ ID NO: 129075 - DNA, 30 bp, Homo sapiens; identical to SEQ ID NO: 31778
  chr8:11540426-11540456
  Hyper

SEQ ID NO: 129076 - DNA, 343 bp, Homo sapiens; identical to SEQ ID NO: 98517
  chr8:11550025-11550368
  Hyper

SEQ ID NO: 129077 - DNA, 82 bp, Homo sapiens; identical to SEQ ID NO: 98518
  chr8:11550619-11550701
  Hyper

SEQ ID NO: 129078 - DNA, 552 bp, Homo sapiens
  chr8:11554969-11555521
  Hyper
tggggaagcggtgttcggaggggagcagcgctctcggtgggcacctgctgcagttggggagggagaggtggtcgtggaggccactttcccctccaccgccagggaagcctggtctgtctgaaggggtcctcgcctgcgccgaggatggccggacggccgggcctccggccccagcacagcccccctttcagaggaccccgggtcttcgcgcctgcggaccagaggctgttttcgcacttgggcttcgcgcttccttgacactttcctgtctctgctcgccgcgccaggtcgcggcgcctgcctgggcgtcttctccaactccgggtcacctcggggcgagggcaagggtgccgggccggtggggcgttccggccaccacggggcggaggagggagcggcctttgcggaaacgggccgagctggctcagggaatgccagatctctgggggacccaccagtcccctgatgtgcgcgttgaggtcttgggcctggcggcgctccagccgcgggtgtccctaccataaccactgtcctccccgggagctgggcaag

SEQ ID NO: 129079 - DNA, 73 bp, Homo sapiens; identical to SEQ ID NO: 98521
  chr8:11558318-11558391
  Hyper

SEQ ID NO: 129080 - DNA, 44 bp, Homo sapiens
  chr8:11559650-11559694
  Hyper
actactaggagaagccggcgtaggagcgccgcctgtgtccttgg

SEQ ID NO: 129081 - DNA, 873 bp, Homo sapiens
  chr8:11560022-11560895
  Hyper
gtctgcttccttctccgctgagtccgaaggatcgcagattggagcgtgctccggagaccgcttttccgcagcgccggcctccgagatccccagcaccccttcagccttaagttcccacgtttcgggtccgtggcgccaattctgctaagtagcaggctaggaattgggggaagtcggagaagaaaccctaagtgtgtcgcccccagcttccgggatgcaggcccgccggggtctagaggggcggctgccgtgcgtccagcctgtgcgcaggcctttcgccgctcggcgccccaggcagcctcagtttcctttcctctgtttgcgccccagtgaacctccgcacctctcattcagggaagagaattccccgcgcagccgcgctcgtttcttcctctgggattttcctgagaatccccaggagttggccacgatcccatggggggtttccttctacccagccccgcgtcctggcctcgtccttaacccccgggttgccttcactcaggctgggaatccacgattgatttcctactacggaagcgggtggcgttcccagcctgctttcggagcagcacgggtttcgtgcagggtgttatcccgaccccttcccccatccctctaatctggcttgagaagcccgtgctggagagaaaaacgcggccttaaaaaaaaaaaaaagtttaaccgaaagcgtgagagccacccgccggctgttatctggggctgaaggctgcggtaatcgatgggttatttttacgcggtaatagggccctgtgattgctctattaacctttagacctgtctgagggactctccggctcgcagccccgctgcgctggggcctccaggctctgacgccgactcccaactcag

SEQ ID NO: 129082 - DNA, 30 bp, Homo sapiens; identical to SEQ ID NO: 9400
  chr8:11561116-11561146
  Hyper

SEQ ID NO: 129083 - DNA, 1665 bp, Homo sapiens
  chr8:11561391-11563056
  Hyper
cacaggaagggggggcggggagggagaaagggaactcattaataaagctgaccctgggcaccacagcgaacccaatcgacctccggctgggttgcgggtgattccccgctccctggcggtagcacttgggcattttccgcggagaccccagagcctggactttgcctgctgggggagctttccgcacagtcccgcagcctgcgcccagcggaggtgtagccggggccgcgcacccccgccccgcccttgcacgtgactcccacaggccagtcagcgccctagggccgagttgctgggccggggacccgagccgcgagctggggacttggaggcggccggcgcaggggccgcgagaggcttcgtcgccgctgcagctccgggggctcccaggggagcgtgcgcggaacctccaggcccagcaggtagggcttttttcttccctttctttgctccttcccgcggtcccccaaactcggagcttctccgcctttgcttgtctggaggtagagaggtagctagtgggaggaaaagagacgtgcgctactcacttcaccgaaattgcccaacccctgctctgcttttgactttgccttagcaacttctttaagtcaaagtaagacttgggggcaaaacagagaaatattggaagcgcctttggattctttccgtgtgaacttgaacgctttcaatccctgtccccgtgtgcacattctccaacccttgtttgcatatcgcaggccggggcctgggtggtgatggtggccgcgtgaagttaccgggactgacgggcccgggacaggctgcacggcagctcgcacatggagggaagtagacggaggcttgtcgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctcaccaccccacctgcccgcgctgcttctacctgaaactggccaagggcccgagcccggaccggagccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggaggttggggaagcgcctcggggaagtgtttcctgtgttcccagaaaaggaagacaaccgagagcaggtttcaggcttttaaagaaagcctggggtgtggaggtgatgctccgcacacgtctgtgtctcctcccctgctgcggccggcttggttgtgccggctagcgtgcgaccgtcctcctcgctgcaggccgagagcggaggcgtaaacccaggccagcgaggagtgtcctataaagggacggggacttttcggcgcttgcaattctcccattctgaaaaatagatcggaagagggctattggttgattcttgaaaggggagcgcatttcctgttggcctgcgaatttggggtgaa

SEQ ID NO: 129084 - DNA, 30 bp, Homo sapiens; identical to SEQ ID NO: 98529
  chr8:11615747-11615777
  Hypo

SEQ ID NO: 129085 - DNA, 30 bp, Homo sapiens; identical to SEQ ID NO: 98531
  chr8:11656439-11656469
  Hypo

SEQ ID NO: 129086 - DNA, 134 bp, Homo sapiens; identical to SEQ ID NO: 98536
  chr8:11704540-11704674
  Hypo

SEQ ID NO: 129087 - DNA, 238 bp, Homo sapiens; identical to SEQ ID NO: 41707
  chr8:11705917-11706155
  Hypo

SEQ ID NO: 129088 - DNA, 64 bp, Homo sapiens; identical to SEQ ID NO: 98539
  chr8:11708426-11708490
  Hypo

SEQ ID NO: 129089 - DNA, 36 bp, Homo sapiens; identical to SEQ ID NO: 98540
  chr8:11726469-11726505
  Hypo

SEQ ID NO: 129090 - DNA, 131 bp, Homo sapiens; identical to SEQ ID NO: 98543
  chr8:11772171-11772302
  Hypo

SEQ ID NO: 129091 - DNA, 42 bp, Homo sapiens; identical to SEQ ID NO: 98594
  chr8:12403483-12403525
  Hypo

SEQ ID NO: 129092 - DNA, 149 bp, Homo sapiens; identical to SEQ ID NO: 41711
  chr8:12671777-12671926
  Hypo

SEQ ID NO: 129093 - DNA, 30 bp, Homo sapiens; identical to SEQ ID NO: 98637
  chr8:12777147-12777177
  Hypo

SEQ ID NO: 129094 - DNA, 68 bp, Homo sapiens; identical to SEQ ID NO: 98639
  chr8:12808843-12808911
  Hyper

SEQ ID NO: 129095 - DNA, 152 bp, Homo sapiens; identical to SEQ ID NO: 98640
  chr8:12809647-12809799
  Hyper

SEQ ID NO: 129096 - DNA, 30 bp, Homo sapiens; identical to SEQ ID NO: 98642
  chr8:12826740-12826770
  Hypo

SEQ ID NO: 129097 - DNA, 86 bp, Homo sapiens; identical to SEQ ID NO: 41712
  chr8:12831656-12831742
  Hypo

SEQ ID NO: 129098 - DNA, 29 bp, Homo sapiens
  chr8:12881832-12881861
  Hypo
tgagccaccgcgcccggcctgttcctttt

SEQ ID NO: 129099 - DNA, 141 bp, Homo sapiens; identical to SEQ ID NO: 98657
  chr8:12949878-12950019
  Hypo

SEQ ID NO: 129100 - DNA, 108 bp, Homo sapiens; identical to SEQ ID NO: 41714
  chr8:12952416-12952524
  Hypo

SEQ ID NO: 129101 - DNA, 90 bp, Homo sapiens; identical to SEQ ID NO: 41715
  chr8:12956998-12957088
  Hypo

SEQ ID NO: 129102 - DNA, 66 bp, Homo sapiens; identical to SEQ ID NO: 98660
  chr8:12957529-12957595
  Hypo

SEQ ID NO: 129103 - DNA, 330 bp, Homo sapiens; identical to SEQ ID NO: 98661
  chr8:12989381-12989711
  Hyper

SEQ ID NO: 129104 - DNA, 113 bp, Homo sapiens; identical to SEQ ID NO: 98662
  chr8:12990035-12990148
  Hyper

SEQ ID NO: 129105 - DNA, 838 bp, Homo sapiens; identical to SEQ ID NO: 98663
  chr8:12990499-12991337
  Hyper

SEQ ID NO: 129106 - DNA, 88 bp, Homo sapiens; identical to SEQ ID NO: 98664
  chr8:13003417-13003505
  Hypo

SEQ ID NO: 129107 - DNA, 568 bp, Homo sapiens; identical to SEQ ID NO: 98682
  chr8:13133827-13134395
  Hyper

SEQ ID NO: 129108 - DNA, 24 bp, Homo sapiens
  chr8:13319913-13319937
  Hypo
tttttttttttgagacggagtctg

SEQ ID NO: 129109 - DNA, 16 bp, Homo sapiens
  chr8:13320204-13320220
  Hypo
gcgcccggcctactat

SEQ ID NO: 129110 - DNA, 228 bp, Homo sapiens
  chr8:13424168-13424396
  Hyper
tttgcaaggttttcccgttgactactcgactttagcaccaaagagaagcaggagtgcagaagacagggcaaaatcgccaacccggcgcaagcagcgcaagcgcagtgggcgctggggagcgcggaggaaaaggcgggacgccgcatggtggccagtcactgcgcatgagcggcccgcgttgccaagacagctgggaaggcgtctcccggaagacgacctccgcagagc

SEQ ID NO: 129111 - DNA, 30 bp, Homo sapiens; identical to SEQ ID NO: 41718
  chr8:13654931-13654961
  Hypo

SEQ ID NO: 129112 - DNA, 101 bp, Homo sapiens; identical to SEQ ID NO: 99100
  chr8:14898126-14898227
  Hypo

SEQ ID NO: 129113 - DNA, 426 bp, Homo sapiens
  chr8:15094345-15094771
  Hyper
aggctggtgggagaccgtgtgcggccggagcctccgcagatgccgcccctaccagcccggctcccgcctccccgccccctgcccgagtccccggacctgctcccgcgcctggggctagggcaggctagccgtccccggcagcgggggtacctctccagcccctgcactgcaactgcgggaggaaacactgcccgcgggcggtgggagggaaaaggggtctcacgaagttctgggataaaaacgggctgtcgttgcagatgcctctgtcacgcgaatctccgagcggaaatgcactgtccccgtgccgggctggggcacaggcgggatcggagccgggaagaggaggcaaagtggcggcgcagctcggacaactttgctgggaaagcaggcgacagcgggcagagctggtgccgctgccccccccgg

SEQ ID NO: 129114 - DNA, 30 bp, Homo sapiens
  chr8:15095073-15095103
  Hyper
ccgcccggacccgcacgtaccttgagctcc

SEQ ID NO: 129115 - DNA, 51 bp, Homo sapiens; identical to SEQ ID NO: 31802
  chr8:15095356-15095407
  Hyper

SEQ ID NO: 129116 - DNA, 33 bp, Homo sapiens; identical to SEQ ID NO: 99107
  chr8:15171865-15171898
  Hypo

SEQ ID NO: 129117 - DNA, 184 bp, Homo sapiens
  chr8:15397713-15397897
  Hyper
ttcctgcccccatcccgcgcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggc

SEQ ID NO: 129118 - DNA, 130 bp, Homo sapiens; identical to SEQ ID NO: 99108
  chr8:15398217-15398347
  Hyper

SEQ ID NO: 129119 - DNA, 53 bp, Homo sapiens; identical to SEQ ID NO: 99119
  chr8:16460002-16460055
  Hypo

SEQ ID NO: 129120 - DNA, 30 bp, Homo sapiens; identical to SEQ ID NO: 99120
  chr8:16687802-16687832
  Hypo

SEQ ID NO: 129121 - DNA, 26 bp, Homo sapiens
  chr8:16760265-16760291
  Hypo
tcgctgggtaaaccacgtgaaaagaa

SEQ ID NO: 129122 - DNA, 367 bp, Homo sapiens; identical to SEQ ID NO: 99122
  chr8:16858724-16859091
  Hyper

SEQ ID NO: 129123 - DNA, 135 bp, Homo sapiens; identical to SEQ ID NO: 99123
  chr8:16859352-16859487
  Hyper

SEQ ID NO: 129124 - DNA, 1029 bp, Homo sapiens
  chr8:16884323-16885352
  Hyper
ctgaggtcaggagaccgttagggaatgtgagtgtcccagacgggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaagctcgcggcaccgacttctcgcgagatttcggcgacccccccccccgcccccgcccctccgttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggtgagtgcgcgagcgcgcgtcacacctgcgcgggggatgtgaccttcgtgccgggtacgcaggaccctggaggctgtggggacggtgcaagcgctgtggccgcgggtgaggaacttcccgtgagcgaggctgacacctaggccggacagcctaggatccggtcacccacgtattgggaagacc

SEQ ID NO: 129125 - DNA, 30 bp, Homo sapiens; identical to SEQ ID NO: 99126
  chr8:17003919-17003949
  Hypo

SEQ ID NO: 129126 - DNA, 291 bp, Homo sapiens
  chr8:17270828-17271119
  Hyper
gcgggcgcggcctcacgcacctgcgcgcctctgcggcgcgatgggaggggcgcggggagggggcttcgcgcccgggagtgggcgggacgcggtcttggctccgcccccaggtgttccgcgcgcggcgtgcggacccggggctcccgcgcggccctagagagcccacctccgcgcctgcgcccacctgcgccgccgccgcgacgcgcctctgcctggggttgccggggcgagggctgctcgctctctcttaacaggggcagccggcggagcactatacggccactgttctcc

SEQ ID NO: 129127 - DNA, 149 bp, Homo sapiens; identical to SEQ ID NO: 99128
  chr8:17354451-17354600
  Hyper

SEQ ID NO: 129128 - DNA, 47 bp, Homo sapiens; identical to SEQ ID NO: 99129
  chr8:17659282-17659329
  Hyper

SEQ ID NO: 129129 - DNA, 84 bp, Homo sapiens; identical to SEQ ID NO: 99134
  chr8:17974435-17974519
  Hypo

SEQ ID NO: 129130 - DNA, 30 bp, Homo sapiens; identical to SEQ ID NO: 99135
  chr8:18062915-18062945
  Hypo

SEQ ID NO: 129131 - DNA, 40 bp, Homo sapiens; identical to SEQ ID NO: 99137
  chr8:18244635-18244675
  Hyper

SEQ ID NO: 129132 - DNA, 41 bp, Homo sapiens; identical to SEQ ID NO: 99139
  chr8:18806532-18806573
  Hypo

SEQ ID NO: 129133 - DNA, 30 bp, Homo sapiens; identical to SEQ ID NO: 99140
  chr8:18870173-18870203
  Hyper

SEQ ID NO: 129134 - DNA, 144 bp, Homo sapiens; identical to SEQ ID NO: 99141
  chr8:18871433-18871577
  Hyper

SEQ ID NO: 129135 - DNA, 18 bp, Homo sapiens
  chr8:19016279-19016297
  Hypo
aaggaagaagtgggccgg

SEQ ID NO: 129136 - DNA, 37 bp, Homo sapiens; identical to SEQ ID NO: 99143
  chr8:19170992-19171029
  Hyper

SEQ ID NO: 129137 - DNA, 1257 bp, Homo sapiens
  chr8:19614007-19615264
  Hyper
caggtgcaggaagtgcgacggaaacaaacaactttgcctccgcttcctacagctttcctctcctccccgcccttctagcccccatcccaccccaagatcatgccctcgaacagcttctgcccaccgatcgcacgtcccctgggcatgttcgggcagcggtgaccctcagccacatcccccactagcccggtcccgggcaggcgagcgcgctgcccaccggccaccctcgtcacgccccctccaccctctccatcccagccacaataatacaataaccgcagtcatcgcgcggcacgtggaaaggctacttttcagtgggttttgcagaaagcaatcagacagcggaaggccacgagaaacgctggtgaagccaaaccgaccccgggagcgcagcggccccggaccctccctggaagctccctccgcgtccccgcgcgcccacctggaggcgccgcgccctccgcctgccaagccggtccccggcccctgcccgtgccctgggcccccggcgggcagcggcggagggaggccaggcgcggcaccgtcctccgcagctgcacgagccaccccgaggtcgcggggtgggcgggcgcgagctaggcgcgcggggctgtggggatctgccggcgccactgacgcccccgcgcggcacaccgcgcccggctggcccgggaggggacccgactcacccgaagcgccctgctagctgcccggcccggctccggccgctgccgccgtcgctgaactttccctcctgcgcggccgccgcggactcggctccacctcccgctccggcagccgcggagcctccagggaccccgggggcggggagcagcggcggcggcggcggctcgggcgggcgggcgcaacagcggccaagcctggcgccccgccgcagggtaggtccggcgggggcggccaaggccgggctggggtcgcggttggccgcgtacctccgcgtcacccacggcctctctgcagtgcgtccctgcgcccgtcggagcggcgccctggccgaagcctgtcactctcggaaggggccgcgctcggacaccaggggcggtttacgcgtgactggacaccaagagccggagaagtttagagactaggacactgtggcgtggcccgagttgcaggagagaggtgtccaatctccatggggtccttactcttgcaggacagagttccccatccccctgctccacccgctctgttcccttggctgccctccccgccgagcgccgacttccatgcaaa

SEQ ID NO: 129138 - DNA, 529 bp, Homo sapiens
  chr8:19797490-19798019
  Hyper
ccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 129139 - DNA, 34 bp, Homo sapiens; identical to SEQ ID NO: 99151
  chr8:20110445-20110479
  Hypo

SEQ ID NO: 129140 - DNA, 972 bp, Homo sapiens
  chr8:20160762-20161734
  Hyper
cggtgtcctccccaccggtgtggacacagctcatctgcaaagttccaggcggcgaagttcagcggcccggaccgaccgccggaccctcttcctgcggcccctgctcctgcggcctcgcgtccccacctcccacttcttcacctccgacaccagtgtcacctaacactgacgtccccgccaggatcagcatcggtgctgggaatagacgaaccccgtctgcaggagacacgaagacaaagacaggaggacagacgcacagtcacctcctctgggccgggccggagaagcggcgcccaccctgcagaggggagaccctgacagctccacgcggagacaaagacacctcgacagccacggacacagacagacaaagaccgacggacgcgcggacgcacggacggtccggcccggcgaggggaaagcggtttcccgcagccagggcagcagaccctccaggggcgaggagatccccggccaccgcaccttacctgccccctgcgcctcgggcgcacttgagactttttttttttcccagtgtttcccggtgtgttcccgtctctctttttccagagctgctgagcgggccgggccggtcccactgcgcgggatgcagctcccggctcccactcactggccgaggcgggcagagaaactttcggcctccccgcccggccgctgccaacccgccagctccaggcgcgccggcctctgcgcgggtcccggagccggggcggggcggggcggggcggggcggggcggggccggcccggggcggggccagagccggcgccgctgattggcagcgagctgccggcagcctggtctgtgccgctcggcggcctttgttccgggctgacagctggggctgctcgcgacctcgcggctccttcgcgcccgcggcctgcgcggggtcccgggtcccgtctctctgctctcacttccatcagccccattgggcgaccctgccccctc

SEQ ID NO: 129141 - DNA, 37 bp, Homo sapiens; identical to SEQ ID NO: 99154
  chr8:20317340-20317377
  Hypo

SEQ ID NO: 129142 - DNA, 36 bp, Homo sapiens; identical to SEQ ID NO: 99155
  chr8:20317437-20317473
  Hypo

SEQ ID NO: 129143 - DNA, 130 bp, Homo sapiens; identical to SEQ ID NO: 99156
  chr8:20431789-20431919
  Hypo

SEQ ID NO: 129144 - DNA, 63 bp, Homo sapiens; identical to SEQ ID NO: 99157
  chr8:21302252-21302315
  Hypo

SEQ ID NO: 129145 - DNA, 173 bp, Homo sapiens; identical to SEQ ID NO: 41723
  chr8:21393876-21394049
  Hypo

SEQ ID NO: 129146 - DNA, 64 bp, Homo sapiens; identical to SEQ ID NO: 99159
  chr8:21546878-21546942
  Hypo

SEQ ID NO: 129147 - DNA, 183 bp, Homo sapiens; identical to SEQ ID NO: 99160
  chr8:21563318-21563501
  Hypo

SEQ ID NO: 129148 - DNA, 79 bp, Homo sapiens; identical to SEQ ID NO: 99161
  chr8:21585266-21585345
  Hypo

SEQ ID NO: 129149 - DNA, 170 bp, Homo sapiens; identical to SEQ ID NO: 99162
  chr8:21608043-21608213
  Hypo

SEQ ID NO: 129150 - DNA, 135 bp, Homo sapiens; identical to SEQ ID NO: 99163
  chr8:21842170-21842305
  Hypo

SEQ ID NO: 129151 - DNA, 77 bp, Homo sapiens; identical to SEQ ID NO: 99164
  chr8:21868044-21868121
  Hyper

SEQ ID NO: 129152 - DNA, 334 bp, Homo sapiens; identical to SEQ ID NO: 99165
  chr8:21881693-21882027
  Hyper

SEQ ID NO: 129153 - DNA, 30 bp, Homo sapiens; identical to SEQ ID NO: 99166
  chr8:21927030-21927060
  Hypo

SEQ ID NO: 129154 - DNA, 30 bp, Homo sapiens; identical to SEQ ID NO: 99167
  chr8:21959580-21959610
  Hypo

SEQ ID NO: 129155 - DNA, 44 bp, Homo sapiens; identical to SEQ ID NO: 99168
  chr8:21987424-21987468
  Hyper

SEQ ID NO: 129156 - DNA, 214 bp, Homo sapiens; identical to SEQ ID NO: 99169
  chr8:21987861-21988075
  Hyper

SEQ ID NO: 129157 - DNA, 56 bp, Homo sapiens; identical to SEQ ID NO: 99170
  chr8:21988412-21988468
  Hyper

SEQ ID NO: 129158 - DNA, 37 bp, Homo sapiens; identical to SEQ ID NO: 99171
  chr8:22005505-22005542
  Hypo

SEQ ID NO: 129159 - DNA, 62 bp, Homo sapiens; identical to SEQ ID NO: 99172
  chr8:22013920-22013982
  Hyper

SEQ ID NO: 129160 - DNA, 133 bp, Homo sapiens; identical to SEQ ID NO: 99173
  chr8:22089510-22089643
  Hyper

SEQ ID NO: 129161 - DNA, 17 bp, Homo sapiens
  chr8:22101764-22101781
  Hypo
tacgacaactctgtgaa

SEQ ID NO: 129162 - DNA, 30 bp, Homo sapiens; identical to SEQ ID NO: 99175
  chr8:22297450-22297480
  Hypo

SEQ ID NO: 129163 - DNA, 43 bp, Homo sapiens; identical to SEQ ID NO: 99176
  chr8:22549491-22549534
  Hyper

SEQ ID NO: 129164 - DNA, 625 bp, Homo sapiens
  chr8:22562064-22562689
  Hyper
tagtcattaaaggaccgagtctgaataagtaggtctgtgttttggtccagctatggcctcacgtactgggtgccctttgaaaaattctatgtaaacagaatttttgttaaaaaaaaaaaaagcgtcaaagttcacaagggaaagtctggtctctgaaggcaaagtcacctgcgacatgtcccttacccccggcatcagcccctcttcccctgggtgggctttgccgccctgccaccaggtggcctgagatgaaattctgacagtgagtgaggacagggttgttttcagaagccagccgtggggagagatggcagcggaagaagggtgactgccgtcgcgctgtgggtcccccagccccaaatctcagagccgcactcccctctcacacaaacactctctccaagcggtaggaaaggtgcttctagaccccaaacgaaagaaaaagtatgccgcaatggaaactcgaactaatcttcccctcttgccccacttccctcccgcggtcacacttccggcggccaccacagggtattttgggtttgaaaacaaagcgtcagatctatttgagcaacttttgttccattggagtagaagcccaggggcctgtggccgctctgggctcggc

SEQ ID NO: 129165 - DNA, 30 bp, Homo sapiens; identical to SEQ ID NO: 9416
  chr8:22613837-22613867
  Hyper

SEQ ID NO: 129166 - DNA, 30 bp, Homo sapiens; identical to SEQ ID NO: 99179
  chr8:22694146-22694176
  Hypo

SEQ ID NO: 129167 - DNA, 30 bp, Homo sapiens; identical to SEQ ID NO: 99180
  chr8:22708858-22708888
  Hypo

SEQ ID NO: 129168 - DNA, 235 bp, Homo sapiens; identical to SEQ ID NO: 99181
  chr8:22722223-22722458
  Hyper

SEQ ID NO: 129169 - DNA, 69 bp, Homo sapiens; identical to SEQ ID NO: 99182
  chr8:22723292-22723361
  Hyper

SEQ ID NO: 129170 - DNA, 184 bp, Homo sapiens; identical to SEQ ID NO: 99183
  chr8:22760486-22760670
  Hypo

SEQ ID NO: 129171 - DNA, 438 bp, Homo sapiens; identical to SEQ ID NO: 99184
  chr8:22960583-22961021
  Hyper

SEQ ID NO: 129172 - DNA, 417 bp, Homo sapiens
  chr8:23021173-23021590
  Hyper
ctgcccagacatgcccggccgcaggcgacccgggccaagcatccccaccgtgtccccctctctccctgcccactcccggcgccaggtgcgctcttccccagccagggaccgcggcggagactcaccggcagcagaaccgcgacgatgaagacgacgaacttaaggatcttggggtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtg

SEQ ID NO: 129173 - DNA, 579 bp, Homo sapiens; identical to SEQ ID NO: 99186
  chr8:23260467-23261046
  Hyper

SEQ ID NO: 129174 - DNA, 552 bp, Homo sapiens; identical to SEQ ID NO: 99187
  chr8:23261347-23261899
  Hyper

SEQ ID NO: 129175 - DNA, 254 bp, Homo sapiens; identical to SEQ ID NO: 99188
  chr8:23290404-23290658
  Hypo

SEQ ID NO: 129176 - DNA, 30 bp, Homo sapiens; identical to SEQ ID NO: 41728
  chr8:23331189-23331219
  Hypo

SEQ ID NO: 129177 - DNA, 30 bp, Homo sapiens; identical to SEQ ID NO: 41729
  chr8:23340639-23340669
  Hypo

SEQ ID NO: 129178 - DNA, 30 bp, Homo sapiens; identical to SEQ ID NO: 99191
  chr8:23345865-23345895
  Hypo

SEQ ID NO: 129179 - DNA, 136 bp, Homo sapiens; identical to SEQ ID NO: 99192
  chr8:23380707-23380843
  Hypo

SEQ ID NO: 129180 - DNA, 30 bp, Homo sapiens; identical to SEQ ID NO: 41731
  chr8:23395420-23395450
  Hypo

SEQ ID NO: 129181 - DNA, 38 bp, Homo sapiens; identical to SEQ ID NO: 15103
  chr8:23399594-23399632
  Hypo

SEQ ID NO: 129182 - DNA, 152 bp, Homo sapiens; identical to SEQ ID NO: 15104
  chr8:23423918-23424070
  Hypo

SEQ ID NO: 129183 - DNA, 30 bp, Homo sapiens; identical to SEQ ID NO: 99196
  chr8:23424483-23424513
  Hypo

SEQ ID NO: 129184 - DNA, 53 bp, Homo sapiens; identical to SEQ ID NO: 99197
  chr8:23430870-23430923
  Hypo

SEQ ID NO: 129185 - DNA, 1584 bp, Homo sapiens
  chr8:23559338-23560922
  Hyper
ttccaggagagcagtcgtggccagaaaagagtgctcctctggattaacggagtcccctggggcgcggccttatggggatgtttaagtcccaaaggaagaggctcaaagcaggttactcttcgtgaacttcccggatcctcaagttcccagctcttcagcccccttcccgccctcccgtcctcttctctttcttccccaacagctgtcattaattggaggatggtaggcccgctagatcaccatctccattcaccgccgatgccccggggctgctgcgtacagatgcaagagcctctcgggcctctggggttgaagccccaaaagtcacgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatttgcttcttagaatgtgtgt

SEQ ID NO: 129186 - DNA, 30 bp, Homo sapiens; identical to SEQ ID NO: 99200
  chr8:23562792-23562822
  Hyper

SEQ ID NO: 129187 - DNA, 93 bp, Homo sapiens
  chr8:23563061-23563154
  Hyper
cgcaacacaactccccgccagccccttcccttccagcgggctggacacaggtgcgtgggcctcgcagcccggcgcgcacggttgcgcctttgg

SEQ ID NO: 129188 - DNA, 619 bp, Homo sapiens
  chr8:23563791-23564410
  Hyper
cccccacattccccccgtaggaggcaagacctgagcgcttactcacgtggctcccccatccgttccgcgtccatctccaagactgcctcacagggacccccaggaggctccgaaccatccagctttctgtcaccgccgccgccaccagcgttgtgaacctctgaccctcgcggctctgcgtccattctcaggtactgaaagttttccgggctcttccgcacccgcggatgtggcgaagccgcggggcagctccgctcgcgctccagtcgcaggatgtccttgaccgagaagggggtggaggtgacggggctcagcagcatcccgaaggcggatggggcggggccgaggaggtccgggtgaggagcggcaccctgaacttcccgtcttgtcgctgcaggccccgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctccagtccccagtcgccttcctgggagg

SEQ ID NO: 129189 - DNA, 490 bp, Homo sapiens; identical to SEQ ID NO: 99203
  chr8:23564781-23565271
  Hyper

SEQ ID NO: 129190 - DNA, 979 bp, Homo sapiens
  chr8:23566803-23567782
  Hyper
gtttacaatcatcaccgggcacccacaagagaccctgaacttagaatatttccgcggtaggagttccgcctcgtccttccaggggatactgacgactcgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccctctcgaggggtggaaacgtctccattcgaccagagtccgggtctgcggagcaatttacccgccgctttccaagagcaggctccccagcgtagcgagtccttgttatggaaagggtcgtttcggctcaggatgcgcgctcccggcgtagacctggggataggggtccctgtcgcgctcgccccacccctgcagggagcaaggccgtccttctgcagcaccgcgccacgcggcgggaatttgcagtgtcctgctttctggtttcagcttcttcgctcgcttgggtctctctcggtcacctctcggaggggcctggagtccctcctccctcctcctacttcagcgccagaagcattgaaagccgcccgcccgccgagagtggaaccggtacctcgaatctcgctcattccgggtcaattggaggcgcattagcggctgccttgcagtgcaacagaggctcgagtgacaggccacctgcctaagcgctggcgcccaggaaagccggggaggaaactaggaagggaggcgacagcagaaaagccagagagtccagagactcctaggcaggcctccgtgcagccccaacagcgtggtgccgggaggtgtgt

SEQ ID NO: 129191 - DNA, 18 bp, Homo sapiens
  chr8:23567842-23567860
  Hyper
catcgtgatcacctctgt

SEQ ID NO: 129192 - DNA, 630 bp, Homo sapiens
  chr8:23571643-23572273
  Hyper
attaaggatctgatacgatcttttcctaaattgctatgctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctgggacagaccgtcgggggctgactccgggggtttgcgggcgccgagctgcctccgcgcgcgttccactccttcagcgtggaaaagaaaaccctcagcggccagagaggcggcggggccttcccggatcgctgattcggggagccgcaggcggggacgctgctgggcgacgcttatctgcgccgcgctcgccagctccgtttcaattaacattccagtgccgccgcccgccgcgggagcggagtccccaccagcccctggaaaaataaactctaggcctagcggctgtgcgtgcgtgtgtgtgtg

SEQ ID NO: 129193 - DNA, 329 bp, Homo sapiens; identical to SEQ ID NO: 99211
  chr8:23572333-23572662
  Hyper

SEQ ID NO: 129194 - DNA, 850 bp, Homo sapiens
  chr8:23583971-23584821
  Hyper
tacctcttattgcagcggggatactaaggccgggacaacaaaagtacgtcgctgactcgaagctgggcggcgggtttcagaggctgagttcttaacaccagggcacttccttgtagccaccacgcccggctgcatcctccacccggccggtttctagaaataggagataccgagaagttagggtggcccaggtctggccttagatctgcagaggggcgagtgcagattgcgcgatggcgaggctcctgcgacaaggcgaacaccaaggacgcgagctatctggaaccacaaataaaacaaattcagggacggcgttgacaccgcggccacctcctaggcgcttcttggaagggcgcggctgtggtgcccgctctgcccgtggtcccgcttacttttggactctgtcccccatggggctggggtccgggtccgcgccctgacccccgcctccgccgtcagtctctctccgctcccagccgggtggcgccgcagggggtggggttgttttcgtttggccccggggacgtccttgtcattccaacagcctcccggtgcggcccaaacaccctgggccacccgacacctcgcgctgttgacgacgcggggccgccggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagcactttacctgcatggtggccaagacccttcgtccggaccctactcctg

SEQ ID NO: 129195 - DNA, 49 bp, Homo sapiens; identical to SEQ ID NO: 99215
  chr8:23585236-23585285
  Hyper

SEQ ID NO: 129196 - DNA, 30 bp, Homo sapiens; identical to SEQ ID NO: 99216
  chr8:24272681-24272711
  Hyper

SEQ ID NO: 129197 - DNA, 288 bp, Homo sapiens
  chr8:24770293-24770581
  Hyper
gggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagct

SEQ ID NO: 129198 - DNA, 719 bp, Homo sapiens
  chr8:24770893-24771612
  Hyper
aggggaccactgggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaag

SEQ ID NO: 129199 - DNA, 137 bp, Homo sapiens; identical to SEQ ID NO: 99222
  chr8:24772604-24772741
  Hyper

SEQ ID NO: 129200 - DNA, 61 bp, Homo sapiens
  chr8:24799494-24799555
  Hyper
atccgtaggaggccccgccccgcctcccggtggcctggtgctgggccgccctccccctctt

SEQ ID NO: 129201 - DNA, 68 bp, Homo sapiens; identical to SEQ ID NO: 99224
  chr8:24812768-24812836
  Hyper

SEQ ID NO: 129202 - DNA, 1288 bp, Homo sapiens
  chr8:24813140-24814428
  Hyper
cgtcggtgttcttggcggcgctctcggtcagcacggtgaagcggctcttgaaccattcctcagcgttctgcatgttcttggcggccagcttctcgtactgcgcgcggatgtccttgagcgcggcggaaaggtcgggcttggtcacgtccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccctcggcgtcctcgcggctcagcacctcctcttcatagcgcgcctgcaggttgcgcagggtctcctccagcccttcgcgctcgccctggagcgcctgcttctcgttggtggcatcttccgccgccaggcgcaggtcgcggatctcctgctcgtacagcgcccggaagcgggatggctcggagtgcttctggcgcagcaccagcagctcggcttccaggaccttgttctgctgctccagctcgtgcacgcgctcgatgaagctggcgaagcggtcattgaggtcctggagctgcgccttctcctgcgtgcggatggacttgaggtcgttgctgatggcggctacctggctcaggtcgaggttctccagactgggcatcaacgatccagagctggaggagtagctgcggcgcacggacagcgaggaagacaccggcgccgagtagctggagtaagctgagcgtgcggtgctgtagccgctgcgcacgctggagatgtgcacccggggcgtctccacgtagcgccgcttgtaggaggtcgagtagtacggctcgtagctgaaggaactcatggtggcggccggtggctccccggcccgcggcggcggtgggagcccggagagagaggacaggggagagagggaagggggaggatggatggctgtgtgcggctcggcgccgttctgccacccctatttatacgccgggaggctcctgacgcagcctgcgatcgatcacggcacgccggccagtgggggcagcgcgctgctgcagccaaggcgaggattctgcgcaaaagggaaggcggggtcgagctacggcccgaggagctgcggcggtcgtcctttccactttgctcagagggccctgattttctctgagatcccatgccccctcactcatttcccttctgtactcactcacgcagcccctcccgtcctgcattgcccagaccccgtgacacttggatc

SEQ ID NO: 129203 - DNA, 375 bp, Homo sapiens; identical to SEQ ID NO: 99228
  chr8:24815060-24815435
  Hyper

SEQ ID NO: 129204 - DNA, 328 bp, Homo sapiens
  chr8:24816391-24816719
  Hyper
tgaagcctttgactgcagaggaggctgcccagaaaggagaggggcggcgggtgctgcagagggatgcttcagagagaagaaaccattggggcacctgctgcctgccgtcccctgggtagctggaaaaaagaggaacacaggagcaaagggtgagaatgggaccctttcctgtgctgaacccggcccacagagtgggggaaggggcagatccacagcgtttaggcttatcgatctctggtctttttaaatatctcctggcctggccacctcatactccacgacagccttgctttgcaggactcccgaatccagccggggtctgagtttt

SEQ ID NO: 129205 - DNA, 2149 bp, Homo sapiens; identical to SEQ ID NO: 99231
  chr8:24857402-24859551
  Hyper

SEQ ID NO: 129206 - DNA, 398 bp, Homo sapiens; identical to SEQ ID NO: 99232
  chr8:25041548-25041946
  Hyper

SEQ ID NO: 129207 - DNA, 36 bp, Homo sapiens; identical to SEQ ID NO: 99233
  chr8:25042248-25042284
  Hyper

SEQ ID NO: 129208 - DNA, 96 bp, Homo sapiens; identical to SEQ ID NO: 99234
  chr8:25042737-25042833
  Hyper

SEQ ID NO: 129209 - DNA, 41 bp, Homo sapiens; identical to SEQ ID NO: 41735
  chr8:25318815-25318856
  Hypo

SEQ ID NO: 129210 - DNA, 216 bp, Homo sapiens; identical to SEQ ID NO: 41736
  chr8:25397045-25397261
  Hypo

SEQ ID NO: 129211 - DNA, 138 bp, Homo sapiens; identical to SEQ ID NO: 99240
  chr8:25899282-25899420
  Hyper

SEQ ID NO: 129212 - DNA, 1777 bp, Homo sapiens
  chr8:25900408-25902185
  Hyper
gggacagagacagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcgccctcgagcgtgctgagtgtgtgcacacgcttcccagccaaccggtcgcagtcacagcccacctggccatcagatcccatttcaccgaagacttggggctgaggtgaacgcacagattgcgggagctgccctgcggcgctggggtctcccaggttgaaccccggtgcgcaagcaccttcattcactcttttgaaaggggtaacattttggctaagctctcccccactaagtctgctccttccagcttcaacaaactttttgatcccgggaaggaaggaaagcgagggaggcgtctttaaggagcccagctaaggaaatgcgcggcacagttggctctgcggtgctgccttatttcccttagctcgcaggcgggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggacacctggccagtttgggaaagggatcatttctccgtgtgatgttggcacttaaatgtgggtggccaggagggcagcaggggaagcgagggtagtggaagaagttcatcggctctttgggggtagaagggctgcctctctcgcagacaaggacctggaggccacaaatcccaactcagtagtggtgatgagagagtgggaccgtaatgtcttcgtagggtggcaccccggacatggtatttactatcccagcacgcagacgcctaaacacaaagtcaacttcagggatccgcaaaaccagaggctggcgatccctgagccagtctagctgctggtggccttttctcgcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacagggagagagaaaggcacggggtgcgcggggggggtgcaca

SEQ ID NO: 129213 - DNA, 30 bp, Homo sapiens; identical to SEQ ID NO: 99244
  chr8:25902535-25902565
  Hyper

SEQ ID NO: 129214 - DNA, 126 bp, Homo sapiens; identical to SEQ ID NO: 99245
  chr8:25902843-25902969
  Hyper

SEQ ID NO: 129215 - DNA, 899 bp, Homo sapiens; identical to SEQ ID NO: 99246
  chr8:25903468-25904367
  Hyper

SEQ ID NO: 129216 - DNA, 64 bp, Homo sapiens; identical to SEQ ID NO: 99247
  chr8:25904571-25904635
  Hyper

SEQ ID NO: 129217 - DNA, 940 bp, Homo sapiens
  chr8:25904898-25905838
  Hyper
agagtgtggaacagccgtgagcccttcaagacatgcctatgagcccggtgatttttttttcaagggggctttgatcagctgtacctccacgttgccccggaaaggtgcgcagggcacccggagaggcctctggtcagcagtgggcctgggccaagccccaacagtttacccctcaggctcaggttggctggggttaaagggcaaagtcagggtcgagggcaccagcttttctcggcggtaacagctgccacccaaattatgccccctcaggaagcgaatgaattgttcctttctcccagctccctgctgcccgccccaaaacagacggggccgcgctcggcgggcgcccctcctcccagccaaccccccgagacgcgctcaggggcctcggtgccccgctgggaggcaatttgggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcggcggctgcgcctggagggttgctcccacctctgtcgcctccagctacccccaaacaaacctccttttcgatctcgtgcaacacaaaacctgccccgagctgtgcgggggcctggcaagcgcagctgcggccccgggaagcccaatcccgcgggactgcggagcccacgcgctcctcaggctccggccaactagctcggttctgcctctag

SEQ ID NO: 129218 - DNA, 120 bp, Homo sapiens
  chr8:25906048-25906168
  Hyper
ttgctcaatctcgtccggtccagtcatctgggcgccaagtctctcctcccgatcagaggttcggaaattttacttagaaactgctctcctggctgtgttcctgtccggcaggacactggg

SEQ ID NO: 129219 - DNA, 43 bp, Homo sapiens
  chr8:25906974-25907017
  Hyper
cgggtgcagaacgagcgaggaagcaaagcggaaaggtcaagag

SEQ ID NO: 129220 - DNA, 57 bp, Homo sapiens; identical to SEQ ID NO: 31863
  chr8:25907271-25907328
  Hyper

SEQ ID NO: 129221 - DNA, 103 bp, Homo sapiens
  chr8:25907858-25907961
  Hyper
gcacaagcgctcactcggccccgcacgcaagcagcgccccgcgcgcccggggccctcctcggataagggaggggtgacaaaagtctcccgctcactgctgcct

SEQ ID NO: 129222 - DNA, 125 bp, Homo sapiens
  chr8:25908392-25908517
  Hyper
ccccctcacctgccgcgagccgggcaatcatttcggggcgccagtgggtccagggcgcacgggacatggcacccacggaaaacctcagagccagctgggaaaacagagatcgctctcctggccgg

SEQ ID NO: 129223 - DNA, 737 bp, Homo sapiens
  chr8:25908962-25909699
  Hyper
gctttgcttgccttacggataagacagcttaggtgaaagtatctggcacgcagtaggtgttcaataaacgcttgctttccttcagcatctgcaggtgtaagatgaggatgatcacatctgcttatggaattcactgggtcctgagtctcctatggggatgggtttcctttcccccgacctatgcgctcctgaggcagggattctgactcgcttgtccttgcagctcctttgcctggcacagggactggatcgctcagtgggtgataagctttttgtttgttccgcatggaattgcatgtgagaaaagcgctttggaagctgtttggtgcacgcgggcgtcagagggcaccgtaggtcactgagcggggtctcacccagggagagaatgcgacttcattcctaggaggctgtgctgggggctccgcgctgcgcgcggcagtgagtagggcgcaccccgaatgcaagtgcggttcgctgcgtggccgcgtgctgggatggatcgcggaactcgctagataattgaagatctcgaggagctctgaaatggatcttcggtttctacgacaaacccccgtcgatgagtggttcacagagagcttggggagcccctccccgccctgcgccctcaggaagagacgcggctcgcctgacactactggtctctgtctcccgagagccagagccgagctccccgagtggtgctttccagagcccgcattaaacgaagctgggaggga

SEQ ID NO: 129224 - DNA, 30 bp, Homo sapiens; identical to SEQ ID NO: 99256
  chr8:26187766-26187796
  Hypo

SEQ ID NO: 129225 - DNA, 124 bp, Homo sapiens; identical to SEQ ID NO: 99257
  chr8:26267081-26267205
  Hypo

SEQ ID NO: 129226 - DNA, 30 bp, Homo sapiens; identical to SEQ ID NO: 99258
  chr8:26267880-26267910
  Hypo

SEQ ID NO: 129227 - DNA, 200 bp, Homo sapiens; identical to SEQ ID NO: 99259
  chr8:26306037-26306237
  Hyper

SEQ ID NO: 129228 - DNA, 38 bp, Homo sapiens; identical to SEQ ID NO: 99260
  chr8:26370063-26370101
  Hyper

SEQ ID NO: 129229 - DNA, 663 bp, Homo sapiens
  chr8:26370549-26371212
  Hyper
ggcgggggaaccaggcggggctctggggcgcaggggaaagctggagatttgggaagggggtttcagtttgttttttctctctttttttttttttttttttttttttggtggaggaagcagaataaaccaaatcgcgacacgttcctgcgcccttcttggcgcagtggcgcagacacggtccatggcgccttgcgcaatagagtcggtctgcaccccgtctttaagtcgtggccctgggctggaattcccgactgcactctttgctacacccccatagaccgcagacctgcgtctctctctatattcctctcccatctgctacgcccctctgaatttcttcccgccatgttgtgtgccccccccccactcccccgtcaccccaaccacaccaaagtggatgcacgaagcgggaaccttctcgtttcagtctctgctccctgcagcctgccaaggcgagtggacaaactgaagctggggtgtccagcgtcttggctgcccccctcctgtccaccctgcctgtgctatccttgctcatcttcagtgccatcccgcttcccacaccctgagtagcctggcgcccggcttgtccccttttcccatccatcagctcacacccagggtaacggggcgggacccctatccacagtgcgccctcgcccccgg

SEQ ID NO: 129230 - DNA, 480 bp, Homo sapiens; identical to SEQ ID NO: 99263
  chr8:26371670-26372150
  Hyper

SEQ ID NO: 129231 - DNA, 500 bp, Homo sapiens; identical to SEQ ID NO: 99264
  chr8:26372420-26372920
  Hyper

SEQ ID NO: 129232 - DNA, 135 bp, Homo sapiens; identical to SEQ ID NO: 99266
  chr8:26629344-26629479
  Hypo

SEQ ID NO: 129233 - DNA, 159 bp, Homo sapiens; identical to SEQ ID NO: 99267
  chr8:26637232-26637391
  Hypo

SEQ ID NO: 129234 - DNA, 64 bp, Homo sapiens; identical to SEQ ID NO: 99268
  chr8:26721627-26721691
  Hyper

SEQ ID NO: 129235 - DNA, 30 bp, Homo sapiens; identical to SEQ ID NO: 99269
  chr8:26722735-26722765
  Hyper

SEQ ID NO: 129236 - DNA, 1667 bp, Homo sapiens
  chr8:26722986-26724653
  Hyper
ccgatggttgggtagcgcagcgctacaggttgggcgctgctcctggcccgcagttacctacattttgagctgccccaccgaaggctcctgctctctccagcttctaggagcacaggtcaggggacgtaggtgtggaatatgtgctgagacccaggaggctgcggggcatcgtttgaccgcgtccacctgaaagagcgcaaagagaaaggcggctttgagctaggcgccccagggaaagaggctgtgctgagcttgacgggttgggggacaccagttgggagccgggttggttctgcggtccagaagctgcttcgcccggcagcggtggaggcgacttcggagctcatctcgcgcccccaccactgggaacctgcctagcgcactctactgagtcacctctgcccgagttcaggatccgaagcgaaaaacaaacaaaaaaacaaatccccaaaaccccaggctccagcgctcgaagtctggatttcgagcgcaggtaccacgaaattaaaatcctcgaagccccggaggggcgactgcggctggcgagtgtgtcgcacggatcctagccggggaattctggaggatgtactcggtttccgttagaacaggttgcctcgcagtcacctggagggggcggcctgggagagggaacagctgcgacccagggacctcagggccaggaccacgagcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcgggcaggggccgccttcgattttctgggctgggggccaccatctgcgtaagaaacctgggtttccacaactgcgaacctaccgcagggactcggcaggacagcgcggcgtgaggaagtgcccaccttgccttctggggttgggccctgaggtgggacctcgggcaaagactcttgttaaaatcgcaagttggagacctcacaggtggtattaaaaacgtgccactgcagaaacccttttcctcctacctcgagggtgataaacacagggttaaaaagacacttgttcagtagaaggcaacttcgcagaagatgtaagggaatcgggggtggggtagaggggccggtataaaacctggtggaaaaagcgggaggcgctgggaaaagtgggggttccgtctcaccagacggcgggggaggtctgccctcacccactcggccctgcgggacgccggccccggcgcactcacctgaagcgccgctgctgagccaccagctcgcgcgcgggggatgtggacccggcttcggtcccgggagctgcctgcctgctcttctctggaggcggagaggggaccgtgtctccgaggcaccaaatccttgtccttttgcacccgctgactcacccctccaccactgatgtctttaagctcctgaaccgctgtcactttacc

SEQ ID NO: 129237 - DNA, 150 bp, Homo sapiens; identical to SEQ ID NO: 99273
  chr8:26852267-26852417
  Hypo

SEQ ID NO: 129238 - DNA, 30 bp, Homo sapiens; identical to SEQ ID NO: 99275
  chr8:27320956-27320986
  Hypo

SEQ ID NO: 129239 - DNA, 30 bp, Homo sapiens; identical to SEQ ID NO: 99276
  chr8:27449851-27449881
  Hyper

SEQ ID NO: 129240 - DNA, 39 bp, Homo sapiens; identical to SEQ ID NO: 99277
  chr8:27472031-27472070
  Hyper

SEQ ID NO: 129241 - DNA, 440 bp, Homo sapiens; identical to SEQ ID NO: 99278
  chr8:27491124-27491564
  Hyper

SEQ ID NO: 129242 - DNA, 30 bp, Homo sapiens; identical to SEQ ID NO: 99279
  chr8:27779779-27779809
  Hypo

SEQ ID NO: 129243 - DNA, 100 bp, Homo sapiens; identical to SEQ ID NO: 99280
  chr8:27914736-27914836
  Hypo

SEQ ID NO: 129244 - DNA, 30 bp, Homo sapiens; identical to SEQ ID NO: 41739
  chr8:27931084-27931114
  Hypo

SEQ ID NO: 129245 - DNA, 234 bp, Homo sapiens; identical to SEQ ID NO: 99282
  chr8:28209327-28209561
  Hypo

SEQ ID NO: 129246 - DNA, 121 bp, Homo sapiens; identical to SEQ ID NO: 99283
  chr8:28221168-28221289
  Hyper

SEQ ID NO: 129247 - DNA, 34 bp, Homo sapiens; identical to SEQ ID NO: 99284
  chr8:28515693-28515727
  Hyper

SEQ ID NO: 129248 - DNA, 30 bp, Homo sapiens; identical to SEQ ID NO: 99285
  chr8:28926240-28926270
  Hypo

SEQ ID NO: 129249 - DNA, 30 bp, Homo sapiens; identical to SEQ ID NO: 41740
  chr8:28938557-28938587
  Hypo

SEQ ID NO: 129250 - DNA, 30 bp, Homo sapiens; identical to SEQ ID NO: 41741
  chr8:29157762-29157792
  Hypo

SEQ ID NO: 129251 - DNA, 218 bp, Homo sapiens; identical to SEQ ID NO: 99288
  chr8:29209258-29209476
  Hyper

SEQ ID NO: 129252 - DNA, 140 bp, Homo sapiens; identical to SEQ ID NO: 99289
  chr8:29209803-29209943
  Hyper

SEQ ID NO: 129253 - DNA, 35 bp, Homo sapiens; identical to SEQ ID NO: 99290
  chr8:29387332-29387367
  Hyper

SEQ ID NO: 129254 - DNA, 77 bp, Homo sapiens; identical to SEQ ID NO: 99291
  chr8:29387636-29387713
  Hyper

SEQ ID NO: 129255 - DNA, 28 bp, Homo sapiens
  chr8:29596408-29596436
  Hypo
tttttaggctgggcacggtagttcatgc

SEQ ID NO: 129256 - DNA, 28 bp, Homo sapiens
  chr8:29596676-29596704
  Hypo
cagaacaagactccgtctcaaaaaaaaa

SEQ ID NO: 129257 - DNA, 29 bp, Homo sapiens
  chr8:30241265-30241294
  Hyper
tataccccttagcccgtttaaatagccgt

SEQ ID NO: 129258 - DNA, 111 bp, Homo sapiens; identical to SEQ ID NO: 99295
  chr8:30241501-30241612
  Hyper

SEQ ID NO: 129259 - DNA, 67 bp, Homo sapiens; identical to SEQ ID NO: 99296
  chr8:30242630-30242697
  Hyper

SEQ ID NO: 129260 - DNA, 117 bp, Homo sapiens; identical to SEQ ID NO: 99297
  chr8:30243058-30243175
  Hyper

SEQ ID NO: 129261 - DNA, 159 bp, Homo sapiens; identical to SEQ ID NO: 99298
  chr8:30243388-30243547
  Hyper

SEQ ID NO: 129262 - DNA, 1020 bp, Homo sapiens
  chr8:30769168-30770188
  Hyper
aaacttgaagggaaccgtggtatcttcaaagtctccgagttgccagcgacctcagcctctccactttctcgaacatcatccctgggcactgtctcccgacacagccagcgcggtggccatgcgcctcaaaccgagcattccaaacgcggaaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcaggggagaatgaggcgcgcggactgccagtcacccgggcggcgttccccgccctagcgctccagggtcgcgagtcccacaggagtcccgagttgcggtcccggggcggcggggctcccgccccctccccgcccccgcggatatccccacgcaccacgaagatccccacgcgccctgcgcaacgcggctgctccgcgctgccttctgctgactacaaactgcgcctccagggagccagggcgaggcggaggccaccaccaagttgtggcgctctctcctctcgctgcctcagagcagcgagtttctcctcagctgcaaacaaggacgcagggccagctccgtggggctcagcgggggcagagggagagcgaaagcgcgggaacccgcgcatctgaggaaagctaaacatttcacctgtagagtcggctgccctggccctcggaggcccaccttt

SEQ ID NO: 129263 - DNA, 435 bp, Homo sapiens; identical to SEQ ID NO: 99305
  chr8:30890092-30890527
  Hyper

SEQ ID NO: 129264 - DNA, 645 bp, Homo sapiens
  chr8:31496433-31497078
  Hyper
cagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgcgctctctcccagccgcttgctcgcagccccagcagc

SEQ ID NO: 129265 - DNA, 907 bp, Homo sapiens
  chr8:31497426-31498333
  Hyper
ggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgag

SEQ ID NO: 129266 - DNA, 30 bp, Homo sapiens; identical to SEQ ID NO: 99310
  chr8:31728987-31729017
  Hypo

SEQ ID NO: 129267 - DNA, 208 bp, Homo sapiens; identical to SEQ ID NO: 99311
  chr8:32277303-32277511
  Hypo

SEQ ID NO: 129268 - DNA, 158 bp, Homo sapiens; identical to SEQ ID NO: 31883
  chr8:32404798-32404956
  Hyper

SEQ ID NO: 129269 - DNA, 1529 bp, Homo sapiens
  chr8:32405453-32406982
  Hyper
agcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaat

SEQ ID NO: 129270 - DNA, 148 bp, Homo sapiens; identical to SEQ ID NO: 41744
  chr8:32987430-32987578
  Hypo

SEQ ID NO: 129271 - DNA, 439 bp, Homo sapiens; identical to SEQ ID NO: 99319
  chr8:33371767-33372206
  Hyper

SEQ ID NO: 129272 - DNA, 450 bp, Homo sapiens; identical to SEQ ID NO: 99320
  chr8:33456975-33457425
  Hyper

SEQ ID NO: 129273 - DNA, 30 bp, Homo sapiens; identical to SEQ ID NO: 99321
  chr8:33578771-33578801
  Hypo

SEQ ID NO: 129274 - DNA, 89 bp, Homo sapiens; identical to SEQ ID NO: 99322
  chr8:35092605-35092694
  Hyper

SEQ ID NO: 129275 - DNA, 619 bp, Homo sapiens
  chr8:35092985-35093604
  Hyper
ctccgctccgtagttcggggcccggcagcggcgcgagggctgggaactgcgcggcggggactgcgggcgactccggcatccgcgctggcggcagcggtcgccgcgccgtgggaagctatggggacgcgccctttctcggggtgcccattcagcggcggctcggagctccctgccccgctgctttaggaagcgatcgtggagcagagtcactctctgaagactcccgagacccattcgactcgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggtaagcgctgggcggagcgggcagctgggggcgagggcgcaggggcgccagcctgacggagcgggacctgcaccgatggcgttggcttcccaacttgcgccctgcacctcggcgctccaagcccaaccggatgggagccgagtggaggactccgaggggaccacagccttccaacccaagtttgcgatctgccgcaatc

SEQ ID NO: 129276 - DNA, 116 bp, Homo sapiens
  chr8:35093951-35094067
  Hyper
gccagccctggagctcgggagagcggcgtgcaccatcccagtttaaccgcgcctgcagtgcccagccgggatgagcacttggcccgaggctgctcaccaggcgcctcctctccctt

SEQ ID NO: 129277 - DNA, 26 bp, Homo sapiens
  chr8:36179048-36179074
  Hypo
ggccgagacctgcagcggaacctagg

SEQ ID NO: 129278 - DNA, 204 bp, Homo sapiens; identical to SEQ ID NO: 99329
  chr8:36852809-36853013
  Hypo

SEQ ID NO: 129279 - DNA, 34 bp, Homo sapiens; identical to SEQ ID NO: 99330
  chr8:37552075-37552109
  Hyper

SEQ ID NO: 129280 - DNA, 494 bp, Homo sapiens; identical to SEQ ID NO: 99331
  chr8:37552317-37552811
  Hyper

SEQ ID NO: 129281 - DNA, 30 bp, Homo sapiens; identical to SEQ ID NO: 99332
  chr8:37595317-37595347
  Hyper

SEQ ID NO: 129282 - DNA, 901 bp, Homo sapiens
  chr8:37655313-37656214
  Hyper
gtgaagtggagagcacgcctgcagggcacccacgccccggatttccagcctggactagggttgcggactttggggacctgagaagggtgagagcggggaatgctcaggaaagatcgacgctcgtggcccaggagggggctgtggtcctaaccactacggtcgcgtcccggactgggctggaggagtctccggatttacctggctggccttgtcccttcaattggggtcatcccatccttgccccctggcctgccagcgccgcttccagccggtctccttagggcaaggggaggctgggctcagaaaagtcggcccttggaataccggcgctcctgggctgcaggagaccctggcgtccccatccctctagaggcccctctcccacggcgccgtttgtgcagtgagctctgtgctgggtcccgcgtccttgcctctcctttgcctctcctggaagtaactcgagctttggctgtttctccattgacttcgcgcaaagattgcgaagaaagaaacgcggctggggaagcggggttccctcaccgcagcccacccgggcctccttccgcgacttccctcttagtcagggcctcagtacgcctttgctttgctggcagcgagcgctgcagcgccgcagcccgaccccaagcctcctacaagggggtcgcaagtcccagcagccgcgcgagcattggcgacccctccccaccgcagagatttcctgcgccgaccacgtgctcgcagctccacgcacgccgtggatttgagggtcgggcccccgcggccgccgcttcctttcctgtcccaaatccagcctaagagccgcttccctttccctgtcctcctgaccccagtggcaaccgtttctccaccgccccttgcccgcagtcggggctggcccagt

SEQ ID NO: 129283 - DNA, 47 bp, Homo sapiens; identical to SEQ ID NO: 99337
  chr8:37706125-37706172
  Hypo

SEQ ID NO: 129284 - DNA, 30 bp, Homo sapiens; identical to SEQ ID NO: 99338
  chr8:37708497-37708527
  Hypo

SEQ ID NO: 129285 - DNA, 30 bp, Homo sapiens; identical to SEQ ID NO: 99339
  chr8:37721639-37721669
  Hypo

SEQ ID NO: 129286 - DNA, 59 bp, Homo sapiens; identical to SEQ ID NO: 99340
  chr8:37762770-37762829
  Hypo

SEQ ID NO: 129287 - DNA, 1097 bp, Homo sapiens
  chr8:37822626-37823723
  Hyper
ggtcccattttggttcgctactcctcgttcccttttctctccaagcaaagccatcccaccttctcttaataaactccacactcaaaaagttgacccacggacacatcgcatgcttcccgaccctgagccgccggtccctctgccccggttacctacccgtcgagccgttggcaaagcctgggctgcgctgggctgctccgggccgcaggaacgcccgaggggaagagggccgggcgggcggcggcgcagggctccggaggcaggcgacggccgcagcggcacagaagacggcggaaggcgctgcgaaagtccgggctgcggcagtagatgagcgggttgaaggcagaattggcataacctagccagttcagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgcgggttggagtggcagcgctgcgcctcggcgtcggcccctacgcgccaccactggctcatgatgggcgcaaacgacaccgcggccgacacgacccacaccaggaccacagctgtccgggcgcagcgcttggtgaccagtgcgccgtaacgcagcgggttggtcacagccaggtagcggtccacggccagggcgcacagggtttcgatgctggcggtcacacacagcacgtccaccgaggtccacagctcgcagccagtggcgcccaacggccagtggccagtcagcgccaaggtggccgccggcggcaccaccag

SEQ ID NO: 129288 - DNA, 30 bp, Homo sapiens; identical to SEQ ID NO: 99344
  chr8:37891941-37891971
  Hypo

SEQ ID NO: 129289 - DNA, 30 bp, Homo sapiens; identical to SEQ ID NO: 99345
  chr8:37935813-37935843
  Hypo

SEQ ID NO: 129290 - DNA, 99 bp, Homo sapiens; identical to SEQ ID NO: 99346
  chr8:37961833-37961932
  Hypo

SEQ ID NO: 129291 - DNA, 30 bp, Homo sapiens; identical to SEQ ID NO: 41747
  chr8:38005823-38005853
  Hypo

SEQ ID NO: 129292 - DNA, 415 bp, Homo sapiens; identical to SEQ ID NO: 99348
  chr8:38008209-38008624
  Hyper

SEQ ID NO: 129293 - DNA, 30 bp, Homo sapiens; identical to SEQ ID NO: 99349
  chr8:38257005-38257035
  Hypo

SEQ ID NO: 129294 - DNA, 1139 bp, Homo sapiens
  chr8:38323156-38324295
  Hyper
gaggctgctgaacctcggtcaccgagaggaaggtggatgacccgggcgtgggggtgattacccagaccaaggcgcgtcccacggggccctgctacttcgcttttaaacaagcctcagggaggaaaccgggagcccgggccaagggaggaaaatggccactttctgctaaacagtctcaaggctagatagtattccaaaaaaagcgctggtccggaggtgcaaagggtagggcacatctgcggaggaaacagtcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggaccacaaggcgctttcctgcctcaaagactattaccaaacacaactcgaaaatccaaccccgctttcaaacctgtagccgttatttaaacggtaaaacaccccactttagtttccgggggatgcggcccaaatcagtccttaaaaacacacagagagcgcctctggcagcagccgcccacgcccccggccctgcgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtctccagaaatgttaaggagggaggtggtcaagacaggctgaagaatctgagttttaatttgggggagggggaggggaggaagagggaagttaataatgcggctgcggtgtacccgtgtggggtgaaacggaaccagatgcgg

SEQ ID NO: 129295 - DNA, 200 bp, Homo sapiens
  chr8:38324661-38324861
  Hyper
gaaccagattgggaccgaacggtccttccgcccccatcccacacctcggcttaacgaccgtgggttgtcctcccgttccccaaacttccgaccctttcagagaccgtccaagtcataagatcaccccttctggaaaggggagtcgtttttcgctctcagctcaagcagattcagccatttggtgacgacacctccttaaa

SEQ ID NO: 129296 - DNA, 974 bp, Homo sapiens; identical to SEQ ID NO: 99354
  chr8:38325076-38326050
  Hyper

SEQ ID NO: 129297 - DNA, 218 bp, Homo sapiens; identical to SEQ ID NO: 99355
  chr8:38326276-38326494
  Hyper

SEQ ID NO: 129298 - DNA, 76 bp, Homo sapiens; identical to SEQ ID NO: 99356
  chr8:38400221-38400297
  Hypo

SEQ ID NO: 129299 - DNA, 94 bp, Homo sapiens; identical to SEQ ID NO: 99357
  chr8:38614414-38614508
  Hyper

SEQ ID NO: 129300 - DNA, 272 bp, Homo sapiens; identical to SEQ ID NO: 99358
  chr8:38614788-38615060
  Hyper

SEQ ID NO: 129301 - DNA, 31 bp, Homo sapiens; identical to SEQ ID NO: 41748
  chr8:38786050-38786081
  Hypo

SEQ ID NO: 129302 - DNA, 23 bp, Homo sapiens
  chr8:38857793-38857816
  Hypo
agccaccgcgccccagcctctct

SEQ ID NO: 129303 - DNA, 30 bp, Homo sapiens; identical to SEQ ID NO: 99361
  chr8:38965524-38965554
  Hypo

SEQ ID NO: 129304 - DNA, 46 bp, Homo sapiens; identical to SEQ ID NO: 99362
  chr8:39695645-39695691
  Hypo

SEQ ID NO: 129305 - DNA, 77 bp, Homo sapiens; identical to SEQ ID NO: 99363
  chr8:39756231-39756308
  Hypo

SEQ ID NO: 129306 - DNA, 177 bp, Homo sapiens; identical to SEQ ID NO: 99364
  chr8:40630277-40630454
  Hypo

SEQ ID NO: 129307 - DNA, 30 bp, Homo sapiens; identical to SEQ ID NO: 99365
  chr8:40707573-40707603
  Hypo

SEQ ID NO: 129308 - DNA, 53 bp, Homo sapiens; identical to SEQ ID NO: 99366
  chr8:40782590-40782643
  Hypo

SEQ ID NO: 129309 - DNA, 30 bp, Homo sapiens; identical to SEQ ID NO: 99367
  chr8:41137920-41137950
  Hypo

SEQ ID NO: 129310 - DNA, 171 bp, Homo sapiens; identical to SEQ ID NO: 99368
  chr8:41146864-41147035
  Hypo

SEQ ID NO: 129311 - DNA, 1662 bp, Homo sapiens
  chr8:41165709-41167371
  Hyper
tttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggcttcggtggcattgggcggcgtcatggcgatgcagacgtccccctcggggaacttgtcacacttaagcatctcgggccagtagaagccgaagaactgcatgaccggctcgcacgagtcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgccggctctgcgccctgttctccgcgacgtcggggctgcctccgccgcctccccgcgcgcgtcctgccgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtgcgcggggctcctacggccgagccctcggagccgccccgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgagacagtttcgctcttg

SEQ ID NO: 129312 - DNA, 226 bp, Homo sapiens; identical to SEQ ID NO: 99374
  chr8:41424669-41424895
  Hyper

SEQ ID NO: 129313 - DNA, 37 bp, Homo sapiens; identical to SEQ ID NO: 99375
  chr8:41488146-41488183
  Hypo

SEQ ID NO: 129314 - DNA, 564 bp, Homo sapiens; identical to SEQ ID NO: 99376
  chr8:41503824-41504388
  Hyper

SEQ ID NO: 129315 - DNA, 30 bp, Homo sapiens; identical to SEQ ID NO: 41750
  chr8:41510183-41510213
  Hypo

SEQ ID NO: 129316 - DNA, 195 bp, Homo sapiens
  chr8:41511045-41511240
  Hyper
cggagtctggagctgcggggtccgcgggggcgctaagggggctactgggttggctgcagcagcgacctgggagaggaaggtgcaggatcgaggcgggagaggcgagccctgagcccagcttccttgggccgtcaccgaatcggtcccagccgcgctgtgcggcccccctgccgtggcccccgggatgggggagga

SEQ ID NO: 129317 - DNA, 109 bp, Homo sapiens; identical to SEQ ID NO: 99380
  chr8:41511443-41511552
  Hyper

SEQ ID NO: 129318 - DNA, 120 bp, Homo sapiens; identical to SEQ ID NO: 99381
  chr8:41523651-41523771
  Hypo

SEQ ID NO: 129319 - DNA, 147 bp, Homo sapiens; identical to SEQ ID NO: 99382
  chr8:41530122-41530269
  Hypo

SEQ ID NO: 129320 - DNA, 203 bp, Homo sapiens; identical to SEQ ID NO: 99383
  chr8:41531574-41531777
  Hypo

SEQ ID NO: 129321 - DNA, 29 bp, Homo sapiens
  chr8:41535372-41535401
  Hypo
gccaggattacaagcgtgaaccactgcac

SEQ ID NO: 129322 - DNA, 136 bp, Homo sapiens; identical to SEQ ID NO: 99385
  chr8:41539808-41539944
  Hypo

SEQ ID NO: 129323 - DNA, 79 bp, Homo sapiens; identical to SEQ ID NO: 99386
  chr8:41540907-41540986
  Hypo

SEQ ID NO: 129324 - DNA, 62 bp, Homo sapiens; identical to SEQ ID NO: 99387
  chr8:41546283-41546345
  Hypo

SEQ ID NO: 129325 - DNA, 99 bp, Homo sapiens; identical to SEQ ID NO: 99388
  chr8:41552691-41552790
  Hypo

SEQ ID NO: 129326 - DNA, 381 bp, Homo sapiens; identical to SEQ ID NO: 99389
  chr8:41553990-41554371
  Hypo

SEQ ID NO: 129327 - DNA, 107 bp, Homo sapiens; identical to SEQ ID NO: 99390
  chr8:41566310-41566417
  Hypo

SEQ ID NO: 129328 - DNA, 30 bp, Homo sapiens; identical to SEQ ID NO: 99391
  chr8:41582836-41582866
  Hypo

SEQ ID NO: 129329 - DNA, 52 bp, Homo sapiens; identical to SEQ ID NO: 41754
  chr8:41594902-41594954
  Hypo

SEQ ID NO: 129330 - DNA, 30 bp, Homo sapiens; identical to SEQ ID NO: 99393
  chr8:41599293-41599323
  Hypo

SEQ ID NO: 129331 - DNA, 117 bp, Homo sapiens; identical to SEQ ID NO: 99394
  chr8:41611241-41611358
  Hypo

SEQ ID NO: 129332 - DNA, 795 bp, Homo sapiens
  chr8:41624546-41625341
  Hyper
gcggctccacgctcccgcccgtgcccctcttccaggccggccacaagtcccgctgcctcccaaccccggctccagcccctccgcggccgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctcttcattttctctccatgattatgtcagatgggaaagttaatgcgaagcgctctccggagagcaggcacctgctgccaagccctgcgaagggggtgcgcgcgggggcgcgggcgggggtgcagccccagctgcaggtgccggccggcgggctcggggcgggcgtcctgcccctgcggaggggaggcacacacgtccagtggaggtgaggagctccaagctgcatggcctccctccctgcctcccgcctccccgaatgc

SEQ ID NO: 129333 - DNA, 30 bp, Homo sapiens; identical to SEQ ID NO: 99397
  chr8:41632351-41632381
  Hypo

SEQ ID NO: 129334 - DNA, 25 bp, Homo sapiens
  chr8:41638209-41638234
  Hypo
atgcctgtgtgtgcacgtgtgcctg

SEQ ID NO: 129335 - DNA, 218 bp, Homo sapiens; identical to SEQ ID NO: 99399
  chr8:41643385-41643603
  Hypo

SEQ ID NO: 129336 - DNA, 451 bp, Homo sapiens
  chr8:41655043-41655494
  Hyper
cagaatagggcatgccggtctttcagcaggggcccgccgaagggccttgggggcttgaggaggagcagctggggctggcggactcaccgcagcctctgcggggcctgtgacgtgcgggccaggcccccgagggccttatcggccccagaggcgcttgctgtcgggccgggcgctcccggcacgggcgggcggaggggtggcgcccgcctggggaccgcagattacaagagcacctcctcccccaaccccaggaggccccgctccccaggcctcggccggcgcggacccctggttgccccggggtcgagagcagccggggagagctgagttcagagcccagagttggacatcaggccacacgctgagagggtagtaaatgaaagggagtccggtttagtcgcgggcagggcatctcctcttctgcttgtctaaaagtcgctgggtgcagggg

SEQ ID NO: 129337 - DNA, 141 bp, Homo sapiens; identical to SEQ ID NO: 99402
  chr8:41668167-41668308
  Hypo

SEQ ID NO: 129338 - DNA, 34 bp, Homo sapiens; identical to SEQ ID NO: 99403
  chr8:41685657-41685691
  Hyper

SEQ ID NO: 129339 - DNA, 313 bp, Homo sapiens; identical to SEQ ID NO: 99404
  chr8:41686308-41686621
  Hyper

SEQ ID NO: 129340 - DNA, 64 bp, Homo sapiens; identical to SEQ ID NO: 99405
  chr8:41689272-41689336
  Hypo

SEQ ID NO: 129341 - DNA, 81 bp, Homo sapiens; identical to SEQ ID NO: 99406
  chr8:41695929-41696010
  Hypo

SEQ ID NO: 129342 - DNA, 30 bp, Homo sapiens; identical to SEQ ID NO: 99407
  chr8:41707500-41707530
  Hypo

SEQ ID NO: 129343 - DNA, 361 bp, Homo sapiens
  chr8:41733415-41733776
  Hyper
ttgccttcatttctccggctgcatccgaggctccccagaggggccggcgcgcgcccgggcgcacactcgcacacctgcccgcgcgcacacacccgcgcctggccccgcgcgcgcacgtcccgcgacctcgcaggttcgcggcccgcaaccggcagggcaggagcttccaccaatcccctcgcctcacgcctcctgcccaaatatagaaaccgacttccttgtcctagagctcggagcggcggccgccctccctcgctgggctcccgaggcggcgctccccaggcgggcgcggggacggccctgtctggcctcaccagcacgtggggcgctgcctgcgctccagccgcggcaccctggcacc

SEQ ID NO: 129344 - DNA, 30 bp, Homo sapiens; identical to SEQ ID NO: 99410
  chr8:41752415-41752445
  Hypo

SEQ ID NO: 129345 - DNA, 1944 bp, Homo sapiens
  chr8:41753273-41755217
  Hyper
ttctgctaccagatccggagggtcaggaaaggtgctccctgagaagggtcaaggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggtgctgaaaggtctctgcgggcagctggcgggaggattctgcgcgccctcagcctcccggccacccgctctgcccttccagcctgccgccctgtccccttcccggccgcgcagaagcctccgtccctcctctacgcccaccgagccttccccgctcgggtgccgccaactccgccgcaccgggcgccgcgccccaccgcgtcccgggccgcccgacccctgcccccagcagccacttgcaggtgccgcggtcgctgggctttcaccgccgccccctcctaccttcttctttcggtcacgggagcggtttctccgcttcctgttggattcctccttctccttctgctcctggagggcctgcgcctcgatgtctttgattttcttcagctgtttggccgcttgagccatggcgggtcacggcgctcccgtccccgcctcctggacccctagcgctcagcgatccccgaggcgacaccccctaagaaggggaagggggtctctgctccacagaggggacagcgttcgtggcgccccgagggccggctgctgcggggtcgcgggaaggcgaaggcagttccggacgcggagggcgaggggcggctgcccgcggcccgggatggcgctgccgccgcggccggagctcgcttgccggcgcccgggacgggctctgggcagggcccgccgcctccctccctccgcctccctccctctcctgcggcggcggcggcggcgaagcgggggggcgggggcggggaggcggctcgtactgcggcggcggcgggcggtgagcggccgcggaaggggcggattcgggcgctcagcgcgggaaggcccgggggcccggccggcgcggcgaggctgggcgcactgggcgtccgcacggggtcatggcgagcgccgagcttccgcctttgcagagccccgcgccgtcgggcggcgggaacaaagcggccgctctaccccggaccccgctgcgggccgcagggccaagccgggggaagaggggaggctgcggcgggcggcgcgccccgcgcccgggcgacccggcggaccagcgcgcctggcggcggcgagcgcggcgacatcgcgggagcggaggctcggcctagagggcgggcggcagagggcaaggaccgggcttggggagcccccgggcggtggccgctgagggcccggacgcgctactcccgagcccggggtgcggttcctccccgggcgccctcggcgtggggcgcgcgcctccggggctccctggggaagagccggttccccgcgccgcacgctgggagcttgatttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgccgcacaggagccagccggggtccccggctcgggagctgc

SEQ ID NO: 129346 - DNA, 33 bp, Homo sapiens; identical to SEQ ID NO: 99414
  chr8:41755524-41755557
  Hyper

SEQ ID NO: 129347 - DNA, 96 bp, Homo sapiens; identical to SEQ ID NO: 99415
  chr8:41773327-41773423
  Hypo

SEQ ID NO: 129348 - DNA, 69 bp, Homo sapiens; identical to SEQ ID NO: 99416
  chr8:41910270-41910339
  Hypo

SEQ ID NO: 129349 - DNA, 211 bp, Homo sapiens; identical to SEQ ID NO: 99417
  chr8:42009840-42010051
  Hyper

SEQ ID NO: 129350 - DNA, 59 bp, Homo sapiens; identical to SEQ ID NO: 99418
  chr8:42036381-42036440
  Hypo

SEQ ID NO: 129351 - DNA, 157 bp, Homo sapiens; identical to SEQ ID NO: 99419
  chr8:42044825-42044982
  Hypo

SEQ ID NO: 129352 - DNA, 30 bp, Homo sapiens; identical to SEQ ID NO: 99420
  chr8:42050976-42051006
  Hypo

SEQ ID NO: 129353 - DNA, 179 bp, Homo sapiens; identical to SEQ ID NO: 99421
  chr8:42137798-42137977
  Hyper

SEQ ID NO: 129354 - DNA, 176 bp, Homo sapiens; identical to SEQ ID NO: 99422
  chr8:42144632-42144808
  Hypo

SEQ ID NO: 129355 - DNA, 30 bp, Homo sapiens; identical to SEQ ID NO: 99423
  chr8:42147491-42147521
  Hypo

SEQ ID NO: 129356 - DNA, 41 bp, Homo sapiens; identical to SEQ ID NO: 99424
  chr8:42333549-42333590
  Hypo

SEQ ID NO: 129357 - DNA, 160 bp, Homo sapiens; identical to SEQ ID NO: 99425
  chr8:42333890-42334050
  Hypo

SEQ ID NO: 129358 - DNA, 25 bp, Homo sapiens
  chr8:42399256-42399281
  Hypo
caatatgtcaaataccggccgggcg

SEQ ID NO: 129359 - DNA, 30 bp, Homo sapiens; identical to SEQ ID NO: 99427
  chr8:42600848-42600878
  Hypo

SEQ ID NO: 129360 - DNA, 82 bp, Homo sapiens; identical to SEQ ID NO: 99428
  chr8:42661169-42661251
  Hypo

SEQ ID NO: 129361 - DNA, 30 bp, Homo sapiens; identical to SEQ ID NO: 15108
  chr8:42699267-42699297
  Hypo

SEQ ID NO: 129362 - DNA, 77 bp, Homo sapiens; identical to SEQ ID NO: 99430
  chr8:42749678-42749755
  Hypo

SEQ ID NO: 129363 - DNA, 17 bp, Homo sapiens
  chr8:42749995-42750012
  Hypo
cacgtatgtgtaatttc

SEQ ID NO: 129364 - DNA, 274 bp, Homo sapiens
  chr8:43102377-43102651
  Hyper
ctgctccatcgaccacgagtacccggatcccgggtaccacacctgggacgcggaactgcggaagatccacagggcggcagtgaggggcgacgccgcagaggtggagcgccgccgcagaggtcgagcgccgccagatgcgcagaagccgggacttgtacgcccgcgacaggaaagacaggcagcggggcctcagctccaggtgggagggggccctaggcccggcttcccgcagccccgcagccccgcagccccgcagccccgtagccccgaagcc

SEQ ID NO: 129365 - DNA, 48 bp, Homo sapiens; identical to SEQ ID NO: 99434
  chr8:43400747-43400795
  Hypo

SEQ ID NO: 129366 - DNA, 60 bp, Homo sapiens; identical to SEQ ID NO: 99435
  chr8:43401723-43401783
  Hypo

SEQ ID NO: 129367 - DNA, 48 bp, Homo sapiens; identical to SEQ ID NO: 99436
  chr8:43404086-43404134
  Hypo

SEQ ID NO: 129368 - DNA, 192 bp, Homo sapiens; identical to SEQ ID NO: 99437
  chr8:43416667-43416859
  Hypo

SEQ ID NO: 129369 - DNA, 177 bp, Homo sapiens; identical to SEQ ID NO: 99439
  chr8:46935227-46935404
  Hypo

SEQ ID NO: 129370 - DNA, 30 bp, Homo sapiens; identical to SEQ ID NO: 99440
  chr8:47015663-47015693
  Hypo

SEQ ID NO: 129371 - DNA, 30 bp, Homo sapiens; identical to SEQ ID NO: 99441
  chr8:47015813-47015843
  Hypo

SEQ ID NO: 129372 - DNA, 48 bp, Homo sapiens; identical to SEQ ID NO: 99442
  chr8:47016307-47016355
  Hypo

SEQ ID NO: 129373 - DNA, 30 bp, Homo sapiens; identical to SEQ ID NO: 99443
  chr8:47021923-47021953
  Hypo

SEQ ID NO: 129374 - DNA, 179 bp, Homo sapiens; identical to SEQ ID NO: 99444
  chr8:47093235-47093414
  Hypo

SEQ ID NO: 129375 - DNA, 41 bp, Homo sapiens; identical to SEQ ID NO: 99445
  chr8:47122214-47122255
  Hypo

SEQ ID NO: 129376 - DNA, 183 bp, Homo sapiens; identical to SEQ ID NO: 99446
  chr8:47138568-47138751
  Hypo

SEQ ID NO: 129377 - DNA, 183 bp, Homo sapiens; identical to SEQ ID NO: 41768
  chr8:47155037-47155220
  Hypo

SEQ ID NO: 129378 - DNA, 86 bp, Homo sapiens; identical to SEQ ID NO: 99448
  chr8:47159728-47159814
  Hypo

SEQ ID NO: 129379 - DNA, 30 bp, Homo sapiens; identical to SEQ ID NO: 99449
  chr8:47161038-47161068
  Hypo

SEQ ID NO: 129380 - DNA, 108 bp, Homo sapiens; identical to SEQ ID NO: 41769
  chr8:47334490-47334598
  Hypo

SEQ ID NO: 129381 - DNA, 49 bp, Homo sapiens; identical to SEQ ID NO: 99451
  chr8:47355877-47355926
  Hypo

SEQ ID NO: 129382 - DNA, 177 bp, Homo sapiens; identical to SEQ ID NO: 99452
  chr8:47357885-47358062
  Hypo

SEQ ID NO: 129383 - DNA, 162 bp, Homo sapiens; identical to SEQ ID NO: 99453
  chr8:47829382-47829544
  Hyper

SEQ ID NO: 129384 - DNA, 255 bp, Homo sapiens; identical to SEQ ID NO: 99454
  chr8:48021889-48022144
  Hypo

SEQ ID NO: 129385 - DNA, 130 bp, Homo sapiens; identical to SEQ ID NO: 99455
  chr8:48044980-48045110
  Hypo

SEQ ID NO: 129386 - DNA, 527 bp, Homo sapiens; identical to SEQ ID NO: 31932
  chr8:48100170-48100697
  Hyper

SEQ ID NO: 129387 - DNA, 191 bp, Homo sapiens; identical to SEQ ID NO: 99457
  chr8:48294168-48294359
  Hypo

SEQ ID NO: 129388 - DNA, 30 bp, Homo sapiens; identical to SEQ ID NO: 99465
  chr8:48601821-48601851
  Hypo

SEQ ID NO: 129389 - DNA, 26 bp, Homo sapiens
  chr8:48675264-48675290
  Hypo
ttttctttctccgtggcacataaagt

SEQ ID NO: 129390 - DNA, 147 bp, Homo sapiens; identical to SEQ ID NO: 99467
  chr8:48676735-48676882
  Hypo

SEQ ID NO: 129391 - DNA, 45 bp, Homo sapiens; identical to SEQ ID NO: 41774
  chr8:48796372-48796417
  Hypo

SEQ ID NO: 129392 - DNA, 30 bp, Homo sapiens; identical to SEQ ID NO: 99469
  chr8:49058263-49058293
  Hypo

SEQ ID NO: 129393 - DNA, 30 bp, Homo sapiens; identical to SEQ ID NO: 99470
  chr8:49172784-49172814
  Hypo

SEQ ID NO: 129394 - DNA, 30 bp, Homo sapiens; identical to SEQ ID NO: 99471
  chr8:49195117-49195147
  Hypo

SEQ ID NO: 129395 - DNA, 751 bp, Homo sapiens
  chr8:49292866-49293617
  Hyper
aaaggttgacaagagcggggctgggctccggcatgggcgcaaaaacaccagtgcggaggagttctcgggaccccccggggctgcggggccttgcggggacagccccaggcccggagctgcagaaacacccagaccccgcgcctcccggaaccacgcgtctctgtgcacagacattcctgggggcaggctcctgtcctttaacacagtctcaaaggagtcttcaaaaacaaaaagtttacaagcactgatagggaaaacagaaggatgataacaccaagagggactttcccgggagaggacggcttccagggactgagaaaggatgggcaagtgggcggggcccggcgccgtgcgggcagggctggcgccgggagtccccagactcccccgcagtgggaagcacctctcccattcacgccgggcaggacacctggccgggcgggggaggcagcgcaagggccggccggggagtacgggactcgagccggggacctgaggcaggagccaagcatcgtcgcagggcaaccagcagaacggagagggaggcgcgggggcgaaggctggcgggagccgcgctgagggcaggagcccggagccccctagggcagcgccgatccgcccgccccgtcccgccgagctgggcctccgtctgtggcctgcgcagccagggtcgccaagccgcctggaatggctcaggcttccaaaaggagcaggcgccaaaaagagctttgcccgccgggtgatggagatc

SEQ ID NO: 129396 - DNA, 332 bp, Homo sapiens; identical to SEQ ID NO: 99474
  chr8:49309314-49309646
  Hyper

SEQ ID NO: 129397 - DNA, 306 bp, Homo sapiens; identical to SEQ ID NO: 99475
  chr8:49334982-49335288
  Hypo

SEQ ID NO: 129398 - DNA, 90 bp, Homo sapiens; identical to SEQ ID NO: 99476
  chr8:49382293-49382383
  Hypo

SEQ ID NO: 129399 - DNA, 326 bp, Homo sapiens; identical to SEQ ID NO: 99477
  chr8:49390299-49390625
  Hypo

SEQ ID NO: 129400 - DNA, 30 bp, Homo sapiens; identical to SEQ ID NO: 99478
  chr8:49418760-49418790
  Hypo

SEQ ID NO: 129401 - DNA, 523 bp, Homo sapiens
  chr8:49468668-49469191
  Hyper
ttaggaacatttccccggtcggtcattagcgcgcgctctccccgcgcccagggtgcccccgtgcccagggtgcccccgcccggcgcctccgcggtcccctcccgcgcgcacctttccgagtgccagtggggcggccccgagaccgcaattgctctggcccggattgacgagcctccgatgcccatttactgcgcgcggcagccactctggagccgcggcacatctggatggagtcagctgcctagcgccaggggccagcacggcccagccagcggagcgcggcggtgagcgctagggaggccggcgcccgggccgcctccgcggccgaccccctgtccccacccgagcaggatttcctgatgtaaacacagcggctctgcgagaacagagctgctctcctgaatgtgtcatttagtgttctttatctgcttggggtcagcatagcgacttagaaaaacagcagtcttgctttgaatttaaacagcgaagaagccagagggtcctgttccgtatggggggaggg

SEQ ID NO: 129402 - DNA, 67 bp, Homo sapiens; identical to SEQ ID NO: 99482
  chr8:49496353-49496420
  Hypo

SEQ ID NO: 129403 - DNA, 30 bp, Homo sapiens; identical to SEQ ID NO: 99483
  chr8:49527456-49527486
  Hypo

SEQ ID NO: 129404 - DNA, 45 bp, Homo sapiens; identical to SEQ ID NO: 99484
  chr8:49547039-49547084
  Hypo

SEQ ID NO: 129405 - DNA, 268 bp, Homo sapiens; identical to SEQ ID NO: 99486
  chr8:49571915-49572183
  Hypo

SEQ ID NO: 129406 - DNA, 267 bp, Homo sapiens; identical to SEQ ID NO: 41778
  chr8:49608941-49609208
  Hypo

SEQ ID NO: 129407 - DNA, 36 bp, Homo sapiens; identical to SEQ ID NO: 31938
  chr8:49647817-49647853
  Hyper

SEQ ID NO: 129408 - DNA, 30 bp, Homo sapiens; identical to SEQ ID NO: 99490
  chr8:49747114-49747144
  Hypo

SEQ ID NO: 129409 - DNA, 30 bp, Homo sapiens; identical to SEQ ID NO: 41779
  chr8:49773216-49773246
  Hypo

SEQ ID NO: 129410 - DNA, 465 bp, Homo sapiens
  chr8:49782672-49783137
  Hyper
ggaatgcccaagcttcgcccccggctaaacacccccttggcgtccgcctgggggtccccatgaaagtccccgcacgccctccccggccccgccctcctcagagcgtgggccccgcgcgccgccaccgcccggccgggaggcgcggggctccctagaaggctcgggcatgtcggagggagccgcggtgcagagacttgccacgcggctgcccgggcggcgcgcgctggagcagctttgtttcctctgctcccgacgggcatcctgccctgcggaacacccacccgagccctgcgcgggaggggcggccgggaggcgcgcgggcatgcggaggggaaacagggctgcagcttcaagcccaggcaggacgcccttagtcaccttatcggaaagtgggcagcgccgcgtctccggttagtcagagccccaggtaaataaagagctcggtgtctgcggggctctggcctc

SEQ ID NO: 129411 - DNA, 288 bp, Homo sapiens; identical to SEQ ID NO: 99494
  chr8:49808681-49808969
  Hypo

SEQ ID NO: 129412 - DNA, 260 bp, Homo sapiens; identical to SEQ ID NO: 99495
  chr8:49833748-49834008
  Hyper

SEQ ID NO: 129413 - DNA, 396 bp, Homo sapiens; identical to SEQ ID NO: 99496
  chr8:49834319-49834715
  Hyper

SEQ ID NO: 129414 - DNA, 222 bp, Homo sapiens; identical to SEQ ID NO: 41781
  chr8:49959230-49959452
  Hypo

SEQ ID NO: 129415 - DNA, 120 bp, Homo sapiens; identical to SEQ ID NO: 99498
  chr8:50015571-50015691
  Hypo

SEQ ID NO: 129416 - DNA, 99 bp, Homo sapiens; identical to SEQ ID NO: 99499
  chr8:50101810-50101909
  Hypo

SEQ ID NO: 129417 - DNA, 156 bp, Homo sapiens; identical to SEQ ID NO: 41783
  chr8:50314445-50314601
  Hypo

SEQ ID NO: 129418 - DNA, 58 bp, Homo sapiens; identical to SEQ ID NO: 41784
  chr8:50377787-50377845
  Hypo

SEQ ID NO: 129419 - DNA, 18 bp, Homo sapiens
  chr8:50378196-50378214
  Hypo
aaccgcctgtagacggca

SEQ ID NO: 129420 - DNA, 23 bp, Homo sapiens
  chr8:50482465-50482488
  Hypo
accgtgcccggccatgttgttca

SEQ ID NO: 129421 - DNA, 1817 bp, Homo sapiens
  chr8:50822066-50823883
  Hyper
cataaccttaagcaacgttttcacatggactgaaaagcaaaagacccccttaaaaattagcctcaagcagcagatactctctttttaggtttgtgtgtctccgtgaggtcagatggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgcggagcacagcgcggccccttccagccggagctcgcgagccgcggtggcggctggtggccaccccagggaaataaagccgttgctgctgcagcaaaatggctcaaagtccaaccaaagtctggccttttcctgtgagtaaatacgcggcctgtttggttttccgtcccgagtgattcccggctcagtaacgtttctcctccagggagcccactggaactccactggctgtgccgcctcctcgcccgtcccccgcgcgcgccgcaggccggtgcttggagagcgcaatgtccccgggagggaagatcccctacctggaatggatggttccagaccagcgggaacgcgctctaatccttgatggaagcaagcgtgggaggaaagcacaacgtctaggacttccctgtagtgtcagaacaggaagaagaacctgagaagtcgccggggaagggaggccaggagcaggcgtccggccccttcccacagcccgggagaaattagtgttgcgccccgcccctcccggacccccgtccccaccacacacaccagcgcccctcaccagtctttctcgaatttcctctcatgtctatcaataacctccttgtgcagaaatctacactgcacaagttaggagtctgcaagggcgggcggtgttacagtctcgctctttccattttccccttttactccacatagtttcaaaggtccacatggccctggttttgaccagttttccaacagtttcaacgttatgtatttcaacttcccgtctcagttcactggcgtctgcacccgttgccgagtgtgggtggctgagccctgggtgacagcactcgggaccacgcacccatacccttctttatgctcgttgtcagccagttgccaagagcgggagtgaagagcctgcaaggcccgggagagcgcggattccggagtagggaggcgagggggcagcgtgggagaccagagggaaaatgggctgaaaagccaacaaaaaaaacaacgtaaattgggctttgctctggctttacaaaggcagagattgtcgagccctctgactgtctttgtgccttctttatcccgtcctttgtgaaataagccgttttctgcccccactgcaggagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaaggtagccgagtgcagatgctttttcctgtctttttcattctttcattctctgtcttttaaaattttaacaataacctatcgtttccgcgtggagggtctaagaatcttcactgggtttaatttaggaatttcaaattgggtttctcaaaatttgaatgtggtccccttaattggtaatcaagattgcggagttttccaaaatattccttttcatcttatgtaattaaagatccacgagctttccaaagaagctctggattttccacggtacaaatctata

SEQ ID NO: 129422 - DNA, 275 bp, Homo sapiens
  chr8:50824134-50824409
  Hyper
gaaaaaaaaaagaaccggaggggagaaggctagggcggaagacaaggaagctgctgcttggattcgctggtggaggaaagtgcgacctggacctgcgcttaggggctcccgtccccttacttcagcaccagaggggatggacagcgtctccggactgagctgcagccacagggacggaactacgctgccgccgccgctgtccttgccgccactgtcgtcgccacgggcagctgggctacttgctcctcgcagctaaaaggcggtgcctcctatta

SEQ ID NO: 129423 - DNA, 44 bp, Homo sapiens; identical to SEQ ID NO: 99508
  chr8:52183842-52183886
  Hypo

SEQ ID NO: 129424 - DNA, 18 bp, Homo sapiens
  chr8:52230574-52230592
  Hypo
gcccggccagtaattgtc

SEQ ID NO: 129425 - DNA, 34 bp, Homo sapiens; identical to SEQ ID NO: 15119
  chr8:52432891-52432925
  Hypo

SEQ ID NO: 129426 - DNA, 143 bp, Homo sapiens; identical to SEQ ID NO: 99511
  chr8:53352268-53352411
  Hypo

SEQ ID NO: 129427 - DNA, 157 bp, Homo sapiens; identical to SEQ ID NO: 99512
  chr8:53416425-53416582
  Hypo

SEQ ID NO: 129428 - DNA, 49 bp, Homo sapiens; identical to SEQ ID NO: 9511
  chr8:53477121-53477170
  Hyper

SEQ ID NO: 129429 - DNA, 1232 bp, Homo sapiens
  chr8:53477408-53478640
  Hyper
gatcccattgccagccggatttctttacttaactctcaaccgtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcccgtgggctccgtgcggggacaaagccagcgccagcaggaagagtgcgggcaaaggggcgccgggcttaaggggccgcatgttcgcaagccgggaggagagagcgggagactccgggaggatcccgacgcaggtccggagggtgcgcggcccaagagaaggccagcgggaccacagcgcggctacgcggccggccgcagtcttcaccgcgcgcctgcccttgtctacgtcccgggggtcggctggagctgcactgggactcggtcctcagtgtgccgaagcctaagcgctgcggggcgcggggcgggaacgggaggcggtgcctggggccacggggtcgtcccccaggatgagggcgtgtcccagcgcgcgggaccctcggaagtccgcgctgggccgggcgggcaccagcctcggactcagcgggtctcagggctccctgcgcaacgcctgcctcggatccggaccccgggctcgctctctggtcgccgtccccgggaggacccagtagggtaactgccgcgtcgccccggcggttctccctgggctctgtctcccgccgcctccaccccccgagcctcggggtccgtcacggcttcccctggctggcggggtcagtagaacccgcggcgcctaggtccggacggaaaaaagcagggccggggtgcggcctggatgagcggagatctccgcgccttgggctcaaaggtgcggggtgcgctctgctgccgagcccctgctcgctcaggaacactggccacgccgtcacgccagccgcccctgccccaggtctggaggcccgacctgctctcctaggcgcagcaccgcgttctcttccgcgtgggggagcggcgggcggaagaggtctggggctgggcaccggggacacgcgcccagctcccctg

SEQ ID NO: 129430 - DNA, 30 bp, Homo sapiens; identical to SEQ ID NO: 99518
  chr8:53756040-53756070
  Hypo

SEQ ID NO: 129431 - DNA, 30 bp, Homo sapiens; identical to SEQ ID NO: 41787
  chr8:53805607-53805637
  Hypo

SEQ ID NO: 129432 - DNA, 20 bp, Homo sapiens
  chr8:53843008-53843028
  Hypo
acatgcgagttttaaaatca

SEQ ID NO: 129433 - DNA, 152 bp, Homo sapiens
  chr8:53852136-53852288
  Hyper
acaggtagcagagagcgctcacgtggaggaggtttggggcgccgcggcgccacccccacccctcctcgggaccgcgcctatttctaaagttacacgtcgacgaactaacctatgctttaaattcctctttccagccccgtgagtccgcggcg

SEQ ID NO: 129434 - DNA, 41 bp, Homo sapiens
  chr8:53852490-53852531
  Hyper
gccctggcccgccaacgcatcgggcccggacccggcgctga

SEQ ID NO: 129435 - DNA, 895 bp, Homo sapiens
  chr8:53853564-53854459
  Hyper
ctcgcgccccatacccgacctagcagatcggaagcgctgcgactgtgcccgcaggttgaccttgccaagccctccaggtgatgcgcggccatgccgggtgaggagaactgaggctgagatcgccacactgagggctccctaaagccgaggtggaggaagaggagggtagaggaggagggcggtattgctgggaaccgccccctccctgccctgctccctgctgccccacccgagccctggcagtctggaacctggctggagtcggaactctccgcgccttcgaagggaggcccgaggacgctgccggcgcccccaggcgtcggctccgcgcggcccctgctgtagctggcgcacagccccggcgggtccccttgtcctccgcgcgctctgggaagacggtcaggcgcgcgcgtttggcgcccacccctgtgagacccgcttggcctggcgccgcgggcggggaccgctgccgaggccgccagcgcctcttcaactggggaaaacacaacaactcgggatgccccatcggagtgtgtatacacctgtgtgtgtgtgtgtgtggtgtgcgcgcgtttgcggaggcatgaaatgcggggaaagaggctggcgcttggcagtgactgcctagaatatgatacgaatagtgatccttctttctgtctgcccctactccttttctttgccttttccctttcctatccgtgatctcccctgaaaatgtcagactcccggagcaaggaacccggagtagcccgggcgcgcggttccggcgccccctggaggagccagcggccgagtgcttagcgtcggaggatcgcggggctttgtggtggagcactccggctgagcgcgcttcacagcgctgtggcacactggtcatcgttgcttatagagg

SEQ ID NO: 129436 - DNA, 1286 bp, Homo sapiens
  chr8:54163316-54164602
  Hyper
gcgctgcgctgtccccgcgctcaccggatgatcacgaacatgaccagcgagttgcccaccaagcccacgacgaacactacggagtagaccgccgtgatgatgaccgggatggccggggagatgtgcgcgggctccagctgcgcgtcctccgagccggcgctgccgttgctgtcgggctcggcccagccgggaaaccaggcgctgctgttggggggcaggcaggcgctcggggcgcaggtagggcccggctccccgcggaagatctggatcggggagtccatggtggggcgattgcagcaggaaggcgaggacaggcggcacctgcggcgctgcgggagcgaaagaaccggctggacgcggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctcccccagcccctgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgctgaaccgcgcgctcacgagtcccgctcagctcttggcatcacctgctctcggaccccggccccgctctccgcccgagggctgctgttccgccgagcgcagcccccgcctctcagcgcacgtctcccactactggcggcggctctgcggggcggggcggggcgggaccggcgggacgcagccgggacgcggctgggcgctgggggcctgcgggcggagagctcgtctggtgcgcccgccccaggccggcaggtccctgccccgccccgcccgcccggagtcagcccccagctccccagcctcccagccccgcgtcccctccagccccgcaggctcgcccggcccactaactgcccgagcggcacaccgcctggtccccggccatgcagccttccccaagacctgagactgagccatttagatttagtaaaaaggaggagcatgcctatttagtgcaagtatgcacctggattttcatattgtgtctagaacttcttatctgcatagttcgcagtcaggaactacgcttattagaatgg

SEQ ID NO: 129437 - DNA, 39 bp, Homo sapiens; identical to SEQ ID NO: 31961
  chr8:54570523-54570562
  Hyper

SEQ ID NO: 129438 - DNA, 214 bp, Homo sapiens; identical to SEQ ID NO: 99527
  chr8:54582655-54582869
  Hypo

SEQ ID NO: 129439 - DNA, 1708 bp, Homo sapiens
  chr8:54789099-54790807
  Hyper
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagtagcaggggagcaggcggctgatccggaggccagtgtggggccggcaagcggtgactgtctccagaggagcaaaggagccgagtcttgtttttcttggatcaggtttgggacttttattctgtctgaccatttccaccacttgcctcacaagagtctctgtctcgaagcacaggaccgaagcaaaatgcctaatgaagcgtgcctgaggaaggggcaggggcttgcaagtgacttgggaagaaggactggggcgaagggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacccggctggtcctctctcgacttcttagcgtggggtcccgccggccctgccgcccgtggccgccgaagttcccgccctcgccgagggccctcgctccggagtggggcgcagacgcggccgccggcccgcagtcccccgcaggtgccgcccaggactagctgcccggcggaggccgagcacgcttggcggcagctgagcctccaccccaagccccagccggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaag

SEQ ID NO: 129440 - DNA, 3403 bp, Homo sapiens
  chr8:54791767-54795170
  Hyper
ggacaccacagtaaccgtatgctggttttgtttctctctccccaccccagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcgtaacttggcaaaagctcgcgccactgccc

SEQ ID NO: 129441 - DNA, 207 bp, Homo sapiens; identical to SEQ ID NO: 99536
  chr8:55122423-55122630
  Hypo

SEQ ID NO: 129442 - DNA, 40 bp, Homo sapiens; identical to SEQ ID NO: 41788
  chr8:55191496-55191536
  Hypo

SEQ ID NO: 129443 - DNA, 30 bp, Homo sapiens; identical to SEQ ID NO: 41789
  chr8:55285908-55285938
  Hypo

SEQ ID NO: 129444 - DNA, 1547 bp, Homo sapiens
  chr8:55366094-55367641
  Hyper
ccacacacctcaacccggggccacagttggaggtggggagatctaagaaacactccacggatgagtttctgaagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctccggtcatcgggggtaacgcgcgtccccaaatcccctctcgctgtcgccctttttttcagtcctcacggggagaggccggcgcagcagtggagcaccgcaggggctggatcggacccgcactgcagcatctgcagggctccgacctggtgcgggcctccaaggcagggggcgcgcggcggcacagccggtggccgcgattttccgggccactccttccccccttacactcccctcccgcccgcgaccttcgacctccatcctggacccacggggtactggcccggggacaaggaggagacgttaaaggtatcaaggggcgcggcaccgccgcctagacggcgccgggacgcgaggtgcgaatcggcggcgtccggctgcgctgccctacctgggaggtgcgggaccctcggccgcgctccaccgccgcgcgccacctcgtgctggcctccgggaggcagccgcccgcgcacgatttataaatgcaaaggccttattgttgttctttgttcagggataccattgtctagtcatccacgggcagcctggagttttcccagggtttgcggcgcgcactcccctcccccgcccccacagacttgctctccagcgccaacccggatctgcctaggtgcccacgggtccttcccgatcgacttgagtgtccttcctccagcccctgctttcccagcatcgaaaacacaaaagcctgccggaaatcacccagcctttgcctggtcactcaggggcccacggataagcgtggctctgattcctccaggtcagccccacggttcgccacctacccgagttaatttctgcgcccgctgaccaaaggccccaactggcaacgggcacagcttcttggtgcgctagtcgcttccttgcccagcctttagagcctcgggtccggcccaaggacccggggacgtgagcgcaattagtagccaggagccctgcgaccctggaccgtgcagtgctaacgcacccgaacggctatgcgagcggtgtactcggctcttacttgtgaaagttgtttcccccaaccccctgcgtaaatctcttgtgttgagaaaagcaaggcttgcaggaagccactccggatgtttgctgctttacatgtggcatctgtggctggctctgataacgtcccggggcaccacgtattaaagtgaagagactgaaatagaaggctccacacaccgcgcgcgggtcagcgacgtcgccgccctccacactgccccccgaaatataagacaagcgaatgatcagaaga

SEQ ID NO: 129445 - DNA, 2450 bp, Homo sapiens
  chr8:55370113-55372563
  Hyper
ccactgaaacaccctcggcttctgcaaaaagatgtgctttaaagagaatagaatggacgctcggtatgttcatctaaacgaccttgggcaagtacgtcgattccaaggtacaatcagccctcccagacggcttttcgagtctccctaaccccggtgggagaggacgcggcgccagagcccagctccggctagttttcccgggggcaggtgtagccttgggcgcggggccgggggaggggcaaggggcgggcgtggggttggactgggacgtgggactcggaccacggcctgggcgtgggcctaacgacgcgggaccggcccgccctcgccgctccattggccacatctgtgcagaaaaggccccgcggcccaggggcgcccgcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggccgggcgcgctggcgcgaatcgctaggccgatttcttaaaccccaaactgttctttgcgagcctgacgcccaaaaccaggggtgtgtagcggccacgtcctttcttaaggctctgggttcccttcccgcttcccgccctccgaccctccaaagcagctttccgccttgctctccggctcccggattccccaggtggccgggggcgcgggtccaacggctctgggaaggcgacttcccggcacctccgggcggcgcgagagcacccttggccctgaactgggccggttgtgtccatccctcgaccccttccctagttaggtgtccttttctgtttttcgaacgaccgggtgatgggtgagcggaaagccgcttccaggagaccaaaagaaaggggtgcctttagaggacgggtgttccccaagggctcggactcaggagtcccagatctccctctttaacttcaccccggttgcgcaattcaaagtctgaggggggaggtgcgtccaggtggggccaggtggggcctggagcgggagcgcagccgataagccctgcgcccctctcccccttccttccactgtgcaggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccc

SEQ ID NO: 129446 - DNA, 1075 bp, Homo sapiens
  chr8:55379164-55380239
  Hyper
gaccgcgacgtcgcgcgcccgcttcgaggagttttgagctcttagcttggtgccggggcccgcccggcgctagatgaagtgctcgtttactcggcctaagccacggtgactcgaaggtgagaatgcaacttcgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgccgggtagggatcgggcgatgctcggcgcccgagttctccgccgttgaggtggagcccggcggcgggagcttagattctctgtgggccacatggtctcagaagaggccccgcggcccgggggcgcccgcagtgtcgctggaccggcggcagcgctggccacgccgtgggctgggactggcccggaacgcgggtggcggttcggcctcggagacccgcgcagccgtcggagcatctccgtgcctcgctcaccaccttcttttcctccgcgtccggcggagggtttcggcgcgcggggcaggcctggagcgccgtgagcaggccggatgcgggatacgccagtgactaccagagccagacccggagcgcgctgccggcggtgacggctaggctgggcccctgtccttgggccgagttgccgagctccctcggggacttgaaggtgaagggcgaggcgccggccggggccgcgggccgagccaagggcgagtctcgcatccggcgccttccaggtggggcgaaggtcgagcgccagaggctggcgagggacccccgcccagcttgacgcccagctgcgcccgacgccgggggaggcggagcgcggggaacccgggcgccgggaaccccggacgtgggagggctgggcttctgcgcggggagacgccgggcttggcgaacatcctcaagaaccggtcggtggctctacctccgaaaactctttcgtgtttagcgattctcatatttagtgtttccctttagggagacttgaccggcaattgcagact

SEQ ID NO: 129447 - DNA, 572 bp, Homo sapiens
  chr8:55382665-55383237
  Hyper
ccttcctccgggaggcggcgcagcgcggggatcttgcgggaccaggccagagaccaggaccgtcccccaaccgttcgcggccgcgtagccctgggcggcctgggcctgcccttccccgcgcagggctttccctcctgccggtcgctgccccgcacatggctctggtcgtactcccgctccactgccaccactgcccacgccctgcgtccccgtttgaccgcgtggagccggaccccgccttcctcgccccgcgctgccccaggcctgccccgcaccagcagctaagcgcaggtctctactgcaagcccgcagccccctcatcgctgggcctactggcgacccccggcgccatgcgcgtgaactgtgggcgacgggctcgcccttggcgggcggcgcgcgcggtttccagatgcagccgccgcgccggggcagctgacgccgcctccaaagacgcgccctgctggacggcgctgaccccacgcagccagcggagtctcctgggaacagcccaggcgccggtgccgacttcaacctctctgctcaggcctcttgagttgcgttaccagcttacc

SEQ ID NO: 129448 - DNA, 103 bp, Homo sapiens; identical to SEQ ID NO: 99556
  chr8:55394094-55394197
  Hypo

SEQ ID NO: 129449 - DNA, 30 bp, Homo sapiens; identical to SEQ ID NO: 15120
  chr8:55689465-55689495
  Hypo

SEQ ID NO: 129450 - DNA, 133 bp, Homo sapiens; identical to SEQ ID NO: 99558
  chr8:55787730-55787863
  Hypo

SEQ ID NO: 129451 - DNA, 30 bp, Homo sapiens; identical to SEQ ID NO: 99559
  chr8:55987089-55987119
  Hypo

SEQ ID NO: 129452 - DNA, 407 bp, Homo sapiens
  chr8:56013520-56013927
  Hyper
ctccttgaatcactccgatcacagatttaatttttcgagtcatttctggagttgtgggaccacacagctagtttgcaatccctatagctttaagagaaggtatttctagttttggagtaaggagtaagggaggtggcgcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagggaccccggcgtcgggcaggggcctgggccgcgaagggcgggagcgcctccgcacctgcctgagc

SEQ ID NO: 129453 - DNA, 1672 bp, Homo sapiens
  chr8:56014127-56015799
  Hyper
gcctccgagcccgggcgcccgagttacacccattctccccaccatcgtcggccagagccgcgctcccagcccttctccaggtgctggcggctccgaccggaatacaaagaggcctgctcctccctggcccttgctgccgccacacccgtccgtgcccactctccgccgtcctccgcgagggctgcacgcagggacccctcctctcagcgcgctcctccccctcccccagtgtcgctcaaatccacccagcgttccgaaatcccgggagtgggggccttcgactgtcaccctcaggcccccttggccgctcctcccggcccttgggacccgccagggcagtcccccaacccccgcccgccgctcctctcggtcccggcccctcctccgggtccctcctcctccctcgcccctcccgagccagggtgggagcgacggcagctggaagagaagggatgaggtcatcctctccctcggagtcagctggtggaggagaggaagcgggaggagggagcgcgcgcgaggggaggagaggaatgtgcaggtccgaggagcgccgcggcggccgctgctgctcctgctgctggcggcggcggcggctcgggcggcagcagcgaagccgggacggcgaggagcgcgggcggcgggcaggggcgcgcgcggggcgccgcgagcagcttggctccgcgcaggcagccaggcggcgctcctgccggccccaggcgcgccgctagcccggcccagcgcccagcccggcgggcggcgggcggcggcggacggcaggcgagccgacgcaggagcaggaggagggggagccgcaccgcctgggagggaagccggggcgaggcgaggaggtggcgggaggaggagacagcggggaaaggtgtcagataaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttct

SEQ ID NO: 129454 - DNA, 234 bp, Homo sapiens; identical to SEQ ID NO: 99566
  chr8:56361841-56362075
  Hypo

SEQ ID NO: 129455 - DNA, 96 bp, Homo sapiens; identical to SEQ ID NO: 99567
  chr8:56364237-56364333
  Hypo

SEQ ID NO: 129456 - DNA, 174 bp, Homo sapiens; identical to SEQ ID NO: 99568
  chr8:56364850-56365024
  Hypo

SEQ ID NO: 129457 - DNA, 30 bp, Homo sapiens; identical to SEQ ID NO: 99569
  chr8:56367284-56367314
  Hypo

SEQ ID NO: 129458 - DNA, 30 bp, Homo sapiens; identical to SEQ ID NO: 99570
  chr8:56367761-56367791
  Hypo

SEQ ID NO: 129459 - DNA, 95 bp, Homo sapiens; identical to SEQ ID NO: 41794
  chr8:56539998-56540093
  Hypo

SEQ ID NO: 129460 - DNA, 62 bp, Homo sapiens; identical to SEQ ID NO: 99572
  chr8:56602218-56602280
  Hypo

SEQ ID NO: 129461 - DNA, 22 bp, Homo sapiens
  chr8:56613576-56613598
  Hypo
gccgcggtggcttcacgcctgt

SEQ ID NO: 129462 - DNA, 80 bp, Homo sapiens; identical to SEQ ID NO: 99575
  chr8:56688545-56688625
  Hypo

SEQ ID NO: 129463 - DNA, 41 bp, Homo sapiens; identical to SEQ ID NO: 99576
  chr8:56792024-56792065
  Hyper

SEQ ID NO: 129464 - DNA, 30 bp, Homo sapiens; identical to SEQ ID NO: 41796
  chr8:56883198-56883228
  Hypo

SEQ ID NO: 129465 - DNA, 109 bp, Homo sapiens; identical to SEQ ID NO: 99578
  chr8:56929738-56929847
  Hypo

SEQ ID NO: 129466 - DNA, 965 bp, Homo sapiens
  chr8:57025591-57026556
  Hyper
atgacgtccccaaggcgctgcccggggagcgagtcctcgaagacggcagcggagagggacgggcgcaggtcgtaggccaccaccgcgtacagtatgtgctgccgctcccccgaatacggcgcctgcttggtagtcatttgccagagagtgatggcaaaggaataaatgtcggctttaggcgtcacgccctctcctttcaggagctccggggcgcggtgggtgtatgtgcctcctagagggtaagagggtgtctggaagcacagcagatcttccaacttctcagagcaaccgaagtcactaattttacagacatcctgctcactgatcaagatgttcgcgggcttcaggtccaagtgcacaatgctttgcgagtggaggaagagcaggccgttcacaacatctagtgagtacttgagacactttcccaaacttaactgtcctccagtgcggcagtgaggctcccctgcgtccccctcagggtggccggcggcgccatagatgacttggtgtaaagtgacgttgccaccgaactccatgatgatggtccctaggctattggaccctgcgggcgtgcgcgtgctggcagccaccacgcgcacgatgttatcgtggcgcagccttgctacgttgagctcagcccagaaactccgccgagatgctagtcggttcttggtgcacttgttcacttgctttatggccacaggaacaccgcggtaagtcgccttgtacaccgagccaaaccctccagctcccagcctctgcagcaagcacacctgctcccagtcaatggagcaccaggccagccggcgcggcagccgcggggcccgaggaagagtggcccccagaagcagcttcgcaggtagctctgagggactgctgcagggccgcgcgtccaccgatggggaaaactcgctccggaggtaggggcgtagggccaggggcgagggcatcgcactttgcagggg

SEQ ID NO: 129467 - DNA, 678 bp, Homo sapiens
  chr8:57069553-57070231
  Hyper
aaaaacctatgtggacgcatcaacagatgctgaaaaggcatttcctagaagtcggcagccaaacttggtaattcttgcgtgtgataaaggcagccgtctgttctgctcagaaggggtttcctaacaggaggggccgaatgcaggcgtcacatccacgccgccccaggtcgtacacctaggccgtccgggctgtcccagagccgcaggccccgcatcatccgcgtccttagcgcggggcgcggagcccgcagccaggtgcggccgagacccgcgcgccagggaaagcggcgcagcggacgcgggagaaggctggtgggtacaggttgcctccgggccggagcgcccatgcagggcgagctgcgctccgcacaaaattgcggtgggggcgccagaccgccttgctccgcccctgagcggggcgccccggcccaaccccctgagggaggagggtccaggtgccgcagactcttagcccctggcccggcgtccgcccggcaggttctggcactcctcgttggtaagccccgttatttcgtgcgcagtgtttacagaatataaagttcttcaggaaacgatgttataggagaaacgcctggattttccccaaactatcagagagtatcttaactatcaaaaaaaaaaaaaattcatttcagttaacgtcgggaatgagacacc

SEQ ID NO: 129468 - DNA, 30 bp, Homo sapiens; identical to SEQ ID NO: 99585
  chr8:57108924-57108954
  Hypo

SEQ ID NO: 129469 - DNA, 359 bp, Homo sapiens; identical to SEQ ID NO: 99586
  chr8:57232533-57232892
  Hyper

SEQ ID NO: 129470 - DNA, 1713 bp, Homo sapiens
  chr8:57357954-57359667
  Hyper
atgggaagatgactgcgtgtggaggggcccttagctgggatatgttaggagttgtggtgacagccatcttccttctgacagcccaggagagaacccagtgctatccgaggtgctgaacagaggacttctcggggttcccgaattcccagggttaaaacaaacttggtttgtgcggcgacaccgctacccttaccggtccccagatagtcgcggatccccgaagctaagagccagggcaggacttcagtcagtgttccaggaacagctgagacacccaggtcaccacgggctcgcgccgctgcggctccgacccggtgcgaaccgccatacgcgccgcgcggtgggccggaggcagtccgcgtactgttgcggaaactctgtctcacaaggtgcgcaacactcgccgcgcgcaacactcaccaggaagttgatgtcggccgggcgcactaggcggtagctgcacgtcgcgcaatcctggctgcattcggcccgcacggtcgccaggagcccggggccgagcaacagcagccaagtgcaaagtgtcaggaaccgcgccatggactgcgaggagagagggacgcgtgcttcgagcctgcctgggcgcagaacggggtccctcggcaggaccctcgccgcgacagcctcagcaggggatcgtcgagcaaaagcccgcaggaatgctcctttctggggccccgccctcccggccgacagcttttaggtagacgtggaggcgactcagatcgcctcgcggttcccgggatggcgcggtcgcccccaacgcgaggctgcctggggcacccggctcttttcctgggcgtccgcggcccagggcaagattccggagagaacgccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggcaagtgtgaggagggcgggcgtcggggagaagcgggcccgggtgtgctggcggacgtagggcctcaccgtcgcggtcctcagcgtctctgcggggtcacgggccaggctgcggggctctgagcgcctgcctcgccgtcccggggcttaacggctgctggagccactttataattagccccaaaccgaaggaggcgcgcgcgccccaatcgccggcgggctgcagctgacgcaggccctacgccagccccgcgccgacgccttcgcgggaggggtcggtcccccagcacccgcgcgccgctccccccgccgagctcgggtgggggccacagggggcgctcggtggctccccacacggccaggtgacaaacccaaggcagttaggaagtttggggagagtgagataggatcaagtttctccgcataaagtcactgaaattgcaccgtgggatgcgggctccagggagggaagcgaggtgggggcgtttggaaggatagatggactggcttagacttctggaatgtgctggagacccagcgggccggtgaacctgcccctttcccgcctcctccctgggccccctcgcgggtccccgtgggcaccaagca

SEQ ID NO: 129471 - DNA, 382 bp, Homo sapiens
  chr8:57360540-57360922
  Hyper
tttccaggccctctgcgccctctgcaaagggctgatttctacagtcgctaggacctgcagcggcgctgctcccgcggggctccggccgcgctgcatgtcccattatagtcgctagagggcagcgctctcctgcgtaggctgggcttgcggggactggggtctcagttctccgcaggcctcaatgtgcgggcttgacacgcagccctcggattagccccgaagctgcacccgagcaccgcctgcctcccggccggggcatcacggtagcaaggtcgggaaagcagagccctggagtggggctggagaaccccggacatagccctagggagccagcattaccctctgagcaggaaaacacaatgtttcccgctttaggttcttt

SEQ ID NO: 129472 - DNA, 30 bp, Homo sapiens; identical to SEQ ID NO: 99593
  chr8:57427547-57427577
  Hypo

SEQ ID NO: 129473 - DNA, 30 bp, Homo sapiens; identical to SEQ ID NO: 99594
  chr8:57565771-57565801
  Hypo

SEQ ID NO: 129474 - DNA, 39 bp, Homo sapiens; identical to SEQ ID NO: 41798
  chr8:57566358-57566397
  Hypo

SEQ ID NO: 129475 - DNA, 28 bp, Homo sapiens
  chr8:57696848-57696876
  Hypo
ttctttctggccaggcgcggtggctcac

SEQ ID NO: 129476 - DNA, 120 bp, Homo sapiens; identical to SEQ ID NO: 99597
  chr8:57984827-57984947
  Hypo

SEQ ID NO: 129477 - DNA, 30 bp, Homo sapiens; identical to SEQ ID NO: 41799
  chr8:57995953-57995983
  Hypo

SEQ ID NO: 129478 - DNA, 20 bp, Homo sapiens
  chr8:58009302-58009322
  Hypo
caccgcgcccggccgctcct

SEQ ID NO: 129479 - DNA, 281 bp, Homo sapiens; identical to SEQ ID NO: 99600
  chr8:58105899-58106180
  Hypo

SEQ ID NO: 129480 - DNA, 113 bp, Homo sapiens; identical to SEQ ID NO: 99601
  chr8:58106596-58106709
  Hypo

SEQ ID NO: 129481 - DNA, 129 bp, Homo sapiens; identical to SEQ ID NO: 41802
  chr8:58116950-58117079
  Hypo

SEQ ID NO: 129482 - DNA, 165 bp, Homo sapiens; identical to SEQ ID NO: 99603
  chr8:58127855-58128020
  Hypo

SEQ ID NO: 129483 - DNA, 527 bp, Homo sapiens; identical to SEQ ID NO: 99604
  chr8:58130301-58130828
  Hypo

SEQ ID NO: 129484 - DNA, 30 bp, Homo sapiens; identical to SEQ ID NO: 99605
  chr8:58132758-58132788
  Hypo

SEQ ID NO: 129485 - DNA, 288 bp, Homo sapiens; identical to SEQ ID NO: 99606
  chr8:58171442-58171730
  Hypo

SEQ ID NO: 129486 - DNA, 32 bp, Homo sapiens; identical to SEQ ID NO: 99607
  chr8:58172070-58172102
  Hypo

SEQ ID NO: 129487 - DNA, 30 bp, Homo sapiens; identical to SEQ ID NO: 99608
  chr8:58174512-58174542
  Hypo

SEQ ID NO: 129488 - DNA, 30 bp, Homo sapiens; identical to SEQ ID NO: 99609
  chr8:58245377-58245407
  Hypo

SEQ ID NO: 129489 - DNA, 27 bp, Homo sapiens
  chr8:58276371-58276398
  Hypo
ggcgtgagccaccgcacctggctcaat

SEQ ID NO: 129490 - DNA, 38 bp, Homo sapiens; identical to SEQ ID NO: 41804
  chr8:58716351-58716389
  Hypo

SEQ ID NO: 129491 - DNA, 989 bp, Homo sapiens
  chr8:58906952-58907941
  Hyper
agaagggtggggacccggaaggtggggtgggggcgggatggaggcggggcggggtgtacgaggggcgtgtacactggctcagggacacgcgctctcggccacagcaactggctccaagttccctccctcactctccggcgaagcctgcctgagccctcccactcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggattcgggttcagtggtcgcgccgcgccccgactgcggacaatgcgggagctgcgcgcggccaggcggcgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccggggttggagccagggcggggggaagctggccgcgctgcggagcggaggtgggctccgaaagcgcgccgccggttgctgctggaggagtgggactacgaaggatggggactccgctcggccaccgctcctgaatggtctctaatctcggtgttaaatactttatgagagtatcaataccacctaatcctttgctgagaattactgctagaaatgtagattctgaggttccgaaagtttgttttt

SEQ ID NO: 129492 - DNA, 100 bp, Homo sapiens; identical to SEQ ID NO: 99616
  chr8:59059033-59059133
  Hypo

SEQ ID NO: 129493 - DNA, 30 bp, Homo sapiens; identical to SEQ ID NO: 99621
  chr8:59747348-59747378
  Hypo

SEQ ID NO: 129494 - DNA, 43 bp, Homo sapiens; identical to SEQ ID NO: 99622
  chr8:59960049-59960092
  Hypo

SEQ ID NO: 129495 - DNA, 739 bp, Homo sapiens
  chr8:60030169-60030908
  Hyper
gggctgagaaggcagcgcactaaatatctctgtatcaggtaaaaaagccgtttggtgatgactcgccaccaggcaaatgttgggagtcccaacgatttttcccgtggaatgcaccgagggtcgccatggatgtgcctgcaggggctgtgagtatcaggcagatttatcaccaagcgagagttgggcgtctaaaaggcccgcccagcgttttagagaactcaattctctctgccaacgttcatccaacgggactgcttagacacgtccaactagccctaggcgtgggcagtcgtgcccctgcgaccactctgggggaccggtccctgcgtgtcctccctctctgggatgagagagttcgagaagccgggagagtaaccccctccctcgtaccccctgactgtcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgcccggctcccaacaaacttgcaatttccgcgcgcaccccttaaacaggaactgttccccaaaccttgacccagctaccccgctgtgctctggcccgcggacctgtgtccgaacccgggctcggctgccggaaccggtttgagaaaaca

SEQ ID NO: 129496 - DNA, 645 bp, Homo sapiens; identical to SEQ ID NO: 99625
  chr8:60031146-60031791
  Hyper

SEQ ID NO: 129497 - DNA, 148 bp, Homo sapiens; identical to SEQ ID NO: 99626
  chr8:60032140-60032288
  Hyper

SEQ ID NO: 129498 - DNA, 269 bp, Homo sapiens; identical to SEQ ID NO: 32016
  chr8:60032490-60032759
  Hyper

SEQ ID NO: 129499 - DNA, 30 bp, Homo sapiens; identical to SEQ ID NO: 99628
  chr8:60250268-60250298
  Hypo

SEQ ID NO: 129500 - DNA, 155 bp, Homo sapiens; identical to SEQ ID NO: 99629
  chr8:60265545-60265700
  Hypo

SEQ ID NO: 129501 - DNA, 18 bp, Homo sapiens
  chr8:60270884-60270902
  Hypo
ttcttttttttgagacgg

SEQ ID NO: 129502 - DNA, 30 bp, Homo sapiens; identical to SEQ ID NO: 99631
  chr8:60506155-60506185
  Hypo

SEQ ID NO: 129503 - DNA, 562 bp, Homo sapiens
  chr8:61193203-61193765
  Hyper
tctccaagccaaaaacgaattcttcacgctaacactgtcttcctcaggtgtttagtaaaatgtaccgctgctcttcttgactactcagaagacataaaaggtacagccacggcttggaggctagcccgccctccggaccgcagcaggtgcgaacgccagccctgcggaaggctcccgggtgagagcgcaggcggcggaagagcgcaggcggcgagcacgcctccctggagcgcctcccgcccgaaacgcaccaggggagtgggaaagtggcagagacccccgtgggaaagagggggcgtgggggtgctcggagcgcgcagcggcagcaggactcgagtcccgcgctcggcgagacactgacgccgccgcgggaccccggacaccccgactcgcggccacttaccttcctcgtagccccactccacaccctcctcttcttcctcctcatcctcttccttctcggggaaggcgacggtatcttcgatgaagctcaggtccgccatgggaaggccgcggggcccctcggcgctctcggcagcagtgcctgcgccttcgctgggcg

SEQ ID NO: 129504 - DNA, 193 bp, Homo sapiens
  chr8:61194057-61194250
  Hyper
cgacagttagaatgcgcctcggggcgactagtcccaagtcacggaaacctcggcgcatccccgcccgcccttcccccggggtcgcccccgccgcctcctggcgcttcctcgctgcggcgactcctgcttggccgcccgagccttccttccagaagcccgcaagtctcccaaggtcactcgggacccctgtgtg

SEQ ID NO: 129505 - DNA, 30 bp, Homo sapiens; identical to SEQ ID NO: 99638
  chr8:61196626-61196656
  Hypo

SEQ ID NO: 129506 - DNA, 17 bp, Homo sapiens
  chr8:61205300-61205317
  Hypo
gccgacactgtcctaaa

SEQ ID NO: 129507 - DNA, 30 bp, Homo sapiens; identical to SEQ ID NO: 41806
  chr8:61272270-61272300
  Hypo

SEQ ID NO: 129508 - DNA, 82 bp, Homo sapiens; identical to SEQ ID NO: 99641
  chr8:61288499-61288581
  Hypo

SEQ ID NO: 129509 - DNA, 39 bp, Homo sapiens; identical to SEQ ID NO: 99642
  chr8:61325744-61325783
  Hypo

SEQ ID NO: 129510 - DNA, 86 bp, Homo sapiens; identical to SEQ ID NO: 99643
  chr8:61573279-61573365
  Hyper

SEQ ID NO: 129511 - DNA, 30 bp, Homo sapiens; identical to SEQ ID NO: 99644
  chr8:61627523-61627553
  Hypo

SEQ ID NO: 129512 - DNA, 30 bp, Homo sapiens; identical to SEQ ID NO: 41807
  chr8:61777517-61777547
  Hypo

SEQ ID NO: 129513 - DNA, 119 bp, Homo sapiens; identical to SEQ ID NO: 99646
  chr8:61789866-61789985
  Hypo

SEQ ID NO: 129514 - DNA, 505 bp, Homo sapiens; identical to SEQ ID NO: 99647
  chr8:61822378-61822883
  Hyper

SEQ ID NO: 129515 - DNA, 22 bp, Homo sapiens
  chr8:62186531-62186553
  Hypo
tgtagaccggagctgttcctat

SEQ ID NO: 129516 - DNA, 482 bp, Homo sapiens; identical to SEQ ID NO: 99649
  chr8:62200502-62200984
  Hyper

SEQ ID NO: 129517 - DNA, 30 bp, Homo sapiens; identical to SEQ ID NO: 99650
  chr8:62212751-62212781
  Hypo

SEQ ID NO: 129518 - DNA, 108 bp, Homo sapiens; identical to SEQ ID NO: 99651
  chr8:62221730-62221838
  Hypo

SEQ ID NO: 129519 - DNA, 49 bp, Homo sapiens; identical to SEQ ID NO: 99652
  chr8:63056935-63056984
  Hypo

SEQ ID NO: 129520 - DNA, 1811 bp, Homo sapiens; identical to SEQ ID NO: 99653
  chr8:63160266-63162077
  Hyper

SEQ ID NO: 129521 - DNA, 233 bp, Homo sapiens; identical to SEQ ID NO: 99655
  chr8:63998335-63998568
  Hyper

SEQ ID NO: 129522 - DNA, 24 bp, Homo sapiens
  chr8:64023520-64023544
  Hypo
caccgcgcccggccttaagtgttt

SEQ ID NO: 129523 - DNA, 30 bp, Homo sapiens; identical to SEQ ID NO: 99657
  chr8:64039936-64039966
  Hypo

SEQ ID NO: 129524 - DNA, 191 bp, Homo sapiens; identical to SEQ ID NO: 99658
  chr8:64224292-64224483
  Hypo

SEQ ID NO: 129525 - DNA, 22 bp, Homo sapiens
  chr8:64511304-64511326
  Hypo
aatagaacgaagaaaggaggac

SEQ ID NO: 129526 - DNA, 30 bp, Homo sapiens; identical to SEQ ID NO: 99662
  chr8:64557179-64557209
  Hypo

SEQ ID NO: 129527 - DNA, 47 bp, Homo sapiens; identical to SEQ ID NO: 99663
  chr8:64617631-64617678
  Hypo

SEQ ID NO: 129528 - DNA, 463 bp, Homo sapiens; identical to SEQ ID NO: 99666
  chr8:65281329-65281792
  Hyper

SEQ ID NO: 129529 - DNA, 1543 bp, Homo sapiens
  chr8:65281852-65283395
  Hyper
ctgcctctagggagaaaggggaggggggaggggagaagaaaaaggaaagagcgcgtttcctcgccggggttaccggggtggcgcgggcttcgcggccgaggggctgccggcccggcccgcagctcctcgcggccggctgggaagtggcgggtccggctagtccgcgggcgggcggagcgcgccgtcgctgccagtgtccccctttaacattccttccccgagcctttccctgctcctccgctctccgagcccggggcggccccgcagacaccagcgcctctatcctgcgctccttggcgtacgcagccgggcgaggtcgcggcgggaatgggcgccgaggccctgcccgccagggccgcatctgcggcccgagacttacttctgctttgctttcctgcacctggcccggggcaggctttctagtttctgcctcggccagaggagccgacttccgcaggacgggcttggggcagggggtgccggtgggggcagcggggcgaggcgaggtcgcagggagacgaccaggcctgcttgggcctgggccgctccagccgcctcgcctcttcagggacctcgccccgggaccacccgagcggacccacagcttctgaggaaacagctgcctcgggcctaagggtctttgctttcccccaacgcatgcaagcgtgggtcgccagcccagcatgtctggcgtggaggccggaggagggtggggagctggcggtgccctatggccagacgagtaaaagtcggttagtgttttatgcgcctgggggaggcgaagggcgcgggcttgcggggcccgggctgcgagtattgggagggggcgcctcgtgaggccgtgcgaggccgccctccccggcaggcctcgtccacgcccttgtggcctcccagacccgctgcgctttggctaggcgtccctacgcgcctccaccttctccaggtgcacgcctgggcgcggagctaggctgagcccccagcgaggggcgtggggcgaggggcgaggggcgagggcgtgggcgccacgcaggccgcggagcctggtgggcggcgtgaagcgtgcactgcgcctgcctgcccggtcccagcctgccgcccagagctccccgaccaagccttgacagctctcggagcagcgagaagaagaagaggaggaaggacacaaagaggaggaggcggcggcgggcggcgaactgagggcagctcagggggaggaggactcattgtccggtccccccagtccaattgatatgctaatctcttttctgatgccacaacaaagaacacctttgcacttttaaaagacttttgtgccctggctacagaagtttattatccactaattagcaacaacttctggcaacgagttgggttacattttcataagttccaggcctgagcgacgaggtgcgcagggcaggaggaggtttgagagcagggcaaacccgaaacctggcgctagaaaggaatcacccgctcactttcctaggcatagggcgccaggcggggatcgaaagcgaaaagtgtccggaaaaaggttctt

SEQ ID NO: 129530 - DNA, 332 bp, Homo sapiens; identical to SEQ ID NO: 99669
  chr8:65283762-65284094
  Hyper

SEQ ID NO: 129531 - DNA, 235 bp, Homo sapiens
  chr8:65284457-65284692
  Hyper
tgttacattccctttcgatggaactaaatgcggttatctgcggtcctaacctctctcgcatcggagtgcaatgtttctgaacaagctctgttagaactggaaaatgggagggggtgagggagcccactgacgacttaacggaatcttactgaagaaaatacaaagataaccgagatattcatgatattacatctcatgatcttccagacaagcgtctctccggaacaagaaaata

SEQ ID NO: 129532 - DNA, 1072 bp, Homo sapiens
  chr8:65286063-65287135
  Hyper
ccaccgcacggactgcgacgcggattacccgagcgcacgccggctgtaagtaccatcctttcctgcggtagccgggctctgcgtccccggctgggctgggagtgttcgctttgtgaatcgggttgttgcttgtgttttggtgttttggttcacaggggcttcttcgaagcttacacttttcgcacgtgagcgggagaagcgtttcgccggttgtgggcgtgcagaacacgatcctggttgactttgatgcggtgacttggggtggcgggcggggggcggcgggaggcgcggagtcgaggagttcccgcgtcgcgagcatgcttgagagccgccggctcagctccgggctgtaaggttggttcctggcaatggatggaaatcaggtcacagagatccctaagcttgccaggctctcagacacgcttgggagacagaatggaattggaaggagggatctgaagaggagggaggggatccgtgttcccccaccccgggcctagaatggagccccggccagccgcgggccgggccccttggttttcaggacttattcttgccggggttggctcgcacgccagcatcgcgccttcggtgcgtcttttatctccatctcaaatatgggatcttcttgggacgaggactgaatgagggtgggagagagggtgtgtctcacggcgcccaggagggagaaattgtggttctgagaaggtattttttggcctcttgaaaatgtgcaagaattccgcgggcccaggctttctttgtgtggcgggcagcgccaagcgctttgtgcttcacaaggagaaaatggcgagtcctattgtgtttaggccattttcttccggtactaggattttcccaagttcgaaatacttcttgagaaagtagccttctcgtgcccaagaaagtgtgaatcgctgaggctcggccccatggcctggcgtgggtgctgacctcagtttaaaaccaagggcctgttttcttaccgttggggtacttgtatcaaagcacagatatgaccggtttgtgcggatcggtgtcctccaaagatcaacagcggctcttggggttt

SEQ ID NO: 129533 - DNA, 1302 bp, Homo sapiens; identical to SEQ ID NO: 99672
  chr8:65289049-65290351
  Hyper

SEQ ID NO: 129534 - DNA, 788 bp, Homo sapiens
  chr8:65290655-65291443
  Hyper
tctctctcctttcctcggactctggagcgggagcgggcctttccctcgggtcgaccacgccgtaggggacgccgtgaaaagagccgtcgcgcccgctgcctcctgcccgctgcgcagagggctccgcccgtagaggtcaacttccctcacccttttctctctcctgcttgccctccctccgcccggcccaggcgcttccagccccagactgtggccactggctgaggagtgcgagtcggctgcgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaagatgacccagcccgcccttggactctcttttcccaaaatctcccaaccaaacccgcggtaacgttatcaaaggacacagagcccaggcatatctgtgtgtttatcttacaggcacacacgcatggttttctcttttatatgctagatttcatccctgacagcagaaaatgattggcaatggttatgacggagaacatgcaatagcgtggtccttaaaaacctgccattccttacaagtgccttagaaaggattcagggcgaaccaactgggttaattgcattcagtaaaataacacgattacaaaattagatctgtaccagaggggtaattaacttggatccacgccgtcatttgaaaact

SEQ ID NO: 129535 - DNA, 268 bp, Homo sapiens; identical to SEQ ID NO: 99675
  chr8:65291758-65292026
  Hyper

SEQ ID NO: 129536 - DNA, 615 bp, Homo sapiens
  chr8:65292261-65292876
  Hyper
agaacacttgccgcccgcatttccccttgacttctccctttttcttcccaatctcgaggcgttcatgcctggctttaagacgccaagataactctcttgttttggcattgtcgcaatgtccaaatcggtcaaaggagtgggataaggtgaaaggaccaggtcagaaactttagaaggactcggtaaattaatttgtttggaagccagtgaggtggactatgttgaggtagcagttccgcaccacgactttggagccaaagaaaaacccaggccgaaaaagcgagccttgatgtctttgttctgccttggcctgcaggggttgggaacaaaggagaggagctaagaggatgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 129537 - DNA, 215 bp, Homo sapiens
  chr8:65293161-65293376
  Hyper
gcagcttgccaccttcggccaggccttgcagcccggcagccttagtagacgggtacagagggctgagctctgcagaccgctctgctgcgcaggagcctgctcggcgcatcccagccggcgggaggcactggagggccaggaggcctgaaacccgcactgcggaaaaaccgacctcagccacatcctcatagctcacgcgacggaaagaggcaggg

SEQ ID NO: 129538 - DNA, 17 bp, Homo sapiens
  chr8:65385219-65385236
  Hypo
tccgtctcaaaaaaaaa

SEQ ID NO: 129539 - DNA, 152 bp, Homo sapiens; identical to SEQ ID NO: 32039
  chr8:65488217-65488369
  Hyper

SEQ ID NO: 129540 - DNA, 425 bp, Homo sapiens
  chr8:65488704-65489129
  Hyper
taatctctctgcctccgagtagatcccgcgctcccaaatccggcgggggcgcagtatggtgaaccccacacctagctccctcagctgcgtgggtttcaagctgacccaggcgccaccaggcagccccgagtgggcgagtcaagtgcaacttcaaggtcaatgtgcctctgactggggcctggagagctgccaagaatgctgggcttggagcgctggggtcgcgccccgctactgcgccttggaccccgcagtggagggcgctgagaccgcacccccctccccgggcagttttcaggagagggtccagctggggtctccgcggtggggtccagaaacgatattccgggttggattcttcctcggttggggaagcacagctggcggagaattcccacggctctcagtggattcgcttttccagagct

SEQ ID NO: 129541 - DNA, 159 bp, Homo sapiens
  chr8:65489468-65489627
  Hyper
gcactaatttcaatgcggtgctgtctgctgaatattttaaactcctttcaaagcagtaggtgtattccctcccgcagtaacaaaacgatattcatctttacacaaggtgctctggcgtttataatttggtatccaacacccggccgagaatgttccctt

SEQ ID NO: 129542 - DNA, 317 bp, Homo sapiens; identical to SEQ ID NO: 99685
  chr8:65489865-65490182
  Hyper

SEQ ID NO: 129543 - DNA, 30 bp, Homo sapiens; identical to SEQ ID NO: 32043
  chr8:65490463-65490493
  Hyper

SEQ ID NO: 129544 - DNA, 30 bp, Homo sapiens; identical to SEQ ID NO: 99687
  chr8:65492377-65492407
  Hyper

SEQ ID NO: 129545 - DNA, 1302 bp, Homo sapiens
  chr8:65492667-65493969
  Hyper
ccttgcaaacatatgcgctaagctgtgtatacagatggcaggcagaataatggagcaggcgccttttataaagctctagctgctgcctgtcttcagacctgggaaatgaaactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgccgccgcctggaggaggcggcggcggcagcgcgggaagtggcggcggcggcggcggcggggtgggtgtccccgggctgctagtaggttcagccggcgttgggggcgaccctagcctaagcagcctgccggccggggccgccctttgcctcaagtacggcgaaagcgcgagccggggctcggtggccgagagcagcggcggcgagcagagccccgacgacgacagcgacggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcggcggcggcgggggta

SEQ ID NO: 129546 - DNA, 282 bp, Homo sapiens
  chr8:65494029-65494311
  Hyper
gcagcagcagcagcagcagcaagaaatccaaagagcaaaaggcgctgcggcttaacatcaatgcccgagagcgccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgc

SEQ ID NO: 129547 - DNA, 85 bp, Homo sapiens; identical to SEQ ID NO: 99692
  chr8:65498465-65498550
  Hyper

SEQ ID NO: 129548 - DNA, 204 bp, Homo sapiens; identical to SEQ ID NO: 99693
  chr8:65498610-65498814
  Hyper

SEQ ID NO: 129549 - DNA, 45 bp, Homo sapiens; identical to SEQ ID NO: 99694
  chr8:65499022-65499067
  Hyper

SEQ ID NO: 129550 - DNA, 357 bp, Homo sapiens; identical to SEQ ID NO: 99695
  chr8:65499733-65500090
  Hyper

SEQ ID NO: 129551 - DNA, 50 bp, Homo sapiens; identical to SEQ ID NO: 99696
  chr8:65519445-65519495
  Hypo

SEQ ID NO: 129552 - DNA, 30 bp, Homo sapiens; identical to SEQ ID NO: 99697
  chr8:65615338-65615368
  Hypo

SEQ ID NO: 129553 - DNA, 433 bp, Homo sapiens
  chr8:65710950-65711383
  Hyper
cctcgccatctgggtcgcgcgcggcccgcggggcccagggcgcatgcgtggcctggcggccgaggcgcttacctggtgcgccggacaagcaagcagagggccaggagcagcagggccgcggcgagggccaggcccgggaggcccaaccgctccagcgaaaagcggcccgtggccgcggacacttctcctgccatccggcgcgcgctaggccgcggtgggcagcccggggtctgcctgcgaacagcgcggtcggcgactctgcagcctgcggcggcttctctcggcggcgccccctagtccagggccggagaggctggcctgcccgcagcgcagacaggaatgtcaccgtggtctcccaggctgaatgacaaaagttcgtggactgccccctccccgcctatcctccacccacgcgtaccgccccgttccccca

SEQ ID NO: 129554 - DNA, 30 bp, Homo sapiens; identical to SEQ ID NO: 99701
  chr8:65738006-65738036
  Hypo

SEQ ID NO: 129555 - DNA, 90 bp, Homo sapiens; identical to SEQ ID NO: 15127
  chr8:65749819-65749909
  Hypo

SEQ ID NO: 129556 - DNA, 33 bp, Homo sapiens; identical to SEQ ID NO: 41815
  chr8:66055590-66055623
  Hypo

SEQ ID NO: 129557 - DNA, 24 bp, Homo sapiens
  chr8:66216965-66216989
  Hypo
gcgagactccgtctcaaaaacata

SEQ ID NO: 129558 - DNA, 29 bp, Homo sapiens
  chr8:66500568-66500597
  Hypo
caacaggaaacctcacgctattttctttt

SEQ ID NO: 129559 - DNA, 23 bp, Homo sapiens
  chr8:66545046-66545069
  Hypo
cgatactccgtctcaaaaaaaaa

SEQ ID NO: 129560 - DNA, 32 bp, Homo sapiens; identical to SEQ ID NO: 99708
  chr8:66548717-66548749
  Hypo

SEQ ID NO: 129561 - DNA, 92 bp, Homo sapiens; identical to SEQ ID NO: 99709
  chr8:66560181-66560273
  Hypo

SEQ ID NO: 129562 - DNA, 380 bp, Homo sapiens; identical to SEQ ID NO: 99713
  chr8:67024905-67025285
  Hyper

SEQ ID NO: 129563 - DNA, 23 bp, Homo sapiens
  chr8:67028548-67028571
  Hypo
agactagaaacaggtcggcatgg

SEQ ID NO: 129564 - DNA, 615 bp, Homo sapiens; identical to SEQ ID NO: 99715
  chr8:67089421-67090036
  Hyper

SEQ ID NO: 129565 - DNA, 201 bp, Homo sapiens; identical to SEQ ID NO: 99716
  chr8:67117726-67117927
  Hypo

SEQ ID NO: 129566 - DNA, 361 bp, Homo sapiens
  chr8:67344509-67344870
  Hyper
agcagttaccttctacggcaatttcaagggtggatggtgcgagcgccgctggggcagctggcgttctggttcttactccgtgggaaaatggccctgagcccgactggcttgaggcttagacaggtgaccccgcgaagcgggtgggcaggcgcggccgaggggcgggaggcgggcagcctccgtgattggccggcggagggggcggtgtagcgacccgaggagggaagaggactccaagcgccatggccgctgccgcccgagcccgggtcgcgtacttgctgaggcaactgcaacgcgcagcgtgagtgcggggccggcgggcgggcaggggaccgcagggtgcccacgcagccccctgggt

SEQ ID NO: 129567 - DNA, 30 bp, Homo sapiens; identical to SEQ ID NO: 99720
  chr8:67345235-67345265
  Hyper

SEQ ID NO: 129568 - DNA, 30 bp, Homo sapiens; identical to SEQ ID NO: 99721
  chr8:67371236-67371266
  Hypo

SEQ ID NO: 129569 - DNA, 24 bp, Homo sapiens
  chr8:67580710-67580734
  Hypo
gggcgcggtggctcacgcctgtag

SEQ ID NO: 129570 - DNA, 23 bp, Homo sapiens
  chr8:67580974-67580997
  Hypo
caagactccgtctcaaaaaaaaa

SEQ ID NO: 129571 - DNA, 30 bp, Homo sapiens; identical to SEQ ID NO: 99724
  chr8:67638459-67638489
  Hypo

SEQ ID NO: 129572 - DNA, 2370 bp, Homo sapiens
  chr8:67873327-67875697
  Hyper
ggcacaaaaatccttcggaggcatcctgtaagaggcttgcgagactcttaccaagccaccccggctttaaacgcctctccagccacctgtgaaccgcgaaggagccggctttcgcggcggggaccttgccaccagtaccctcgcgggccgaggtcgttctcccggtcggcttcccgcctcacccgaaaaggaattagagcatctacccaagacggtgactggcagggcagatcaaggtgtcctggtctcggccccagccccgcggtgcgccccgcccgcttaccttgaccgggtgcaggtagccatcgccgcgcagggcgcccaacccggcgtccgccggcgcctcggcgtcgtcctgcaggctgcgggtgagatgcgcgatgtaggtggtggccagcagcagcacgtccagcttggacagcttggtgtcgggcggcacggacggcagcgtgcgctgcagctccaggaaagcgtgccgcagggtctgcacccggctgcgctcccgcgccgcattcgccgccgccggccgcccgctcccggaacgcgagccgcccccagggcccgccggccccggcccggtccgcccgggacgcgagtcgcggatggcggcggccaggggcgcgggctcggcgctggcgctgagggggctgcccgctgggcggccgcggtccatggcagcttcccgcgccgcgcgcgctgcaaaggaccgaaggtgcggtgaggccggggggcggtcgggcttaacccgagaggcgcagccccctggttctccccgtgcgcccaccagcagcccaacggggctaagggcgctctcaagcgagctcgttttgcctgggacgcgatttgcttccggacgtctggggagagttgcggaactccggagttcttgggcttcctagaaggataagaagaggcgcagtgccggctttgcttttcaggggcaaattaagcaaaaggtctactctacccgggaagaaagatctcggaagcacagctcaggatcagcactcgttcgcgcttgggtgactttatccaacccggcacgcacgagaggtggcgcggctccttctcgccgacgccgcggaaaaccacggctcaccagccgccctcggcctttcacgccaggggggatttctgcccgaggagcgggggacccttagcctcacctcggggtacggcacccgccaccgttccgagcccgagagctgcgcagtacgcgtctgacgggcccctcacctttcctggagcggctgagtggagctccgctccgtcgtgagggcgggcgaggggcgtggagcagggcctgtgtggccagggccgcgctggtcactccatcctcgtccggccgatgcccaagtcgacggctgtttccaacctccgctggctgtgacttttatgcgggcgccccgcggccaggcgtgtgtgctccgaccggctaaggcaggtcgggcggaggacctggcccaccggagaggctacgccgggggctgaggcggcttagagggtcattaatcaaaccctccggcggggcgggctcgggggcggggcgtcctcctggccccgcccctcggctcactgcctcacgctgctttccccgaggcgcctcgctgagggcggcgtgtggagagtttggggtgtctgccgccggctgcggtggggccgggctggaggccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccgaatgctctcagtgtctgtaattctttaagaagttcctagagcagacagcccttggatcgtgggcacttctccccggggacggggaccctgctgaccgcctccgctgcccccgcgggggccaccgctctttaattatttgggcgaaacattcttttctggttttgcacttgtggactcacgggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcgtaggtgaaatctaagtacttttcagcaacataattagaacacactcgaaacaatgcctgcagttctccgagtaggacattttctgtttttgtgtttg

SEQ ID NO: 129573 - DNA, 386 bp, Homo sapiens; identical to SEQ ID NO: 99734
  chr8:67940624-67941010
  Hyper

SEQ ID NO: 129574 - DNA, 30 bp, Homo sapiens; identical to SEQ ID NO: 99735
  chr8:68107540-68107570
  Hypo

SEQ ID NO: 129575 - DNA, 105 bp, Homo sapiens; identical to SEQ ID NO: 99736
  chr8:68347722-68347827
  Hypo

SEQ ID NO: 129576 - DNA, 29 bp, Homo sapiens
  chr8:68780039-68780068
  Hypo
gtattcataaggatacgattttttttttt

SEQ ID NO: 129577 - DNA, 76 bp, Homo sapiens; identical to SEQ ID NO: 99743
  chr8:68864043-68864119
  Hyper

SEQ ID NO: 129578 - DNA, 16 bp, Homo sapiens
  chr8:68864179-68864195
  Hyper
gcgtgtgtgtgattag

SEQ ID NO: 129579 - DNA, 398 bp, Homo sapiens
  chr8:68864498-68864896
  Hyper
tcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggc

SEQ ID NO: 129580 - DNA, 126 bp, Homo sapiens; identical to SEQ ID NO: 99746
  chr8:68865314-68865440
  Hyper

SEQ ID NO: 129581 - DNA, 208 bp, Homo sapiens; identical to SEQ ID NO: 99748
  chr8:69242803-69243011
  Hyper

SEQ ID NO: 129582 - DNA, 900 bp, Homo sapiens
  chr8:69243071-69243971
  Hyper
ttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggtaaggcgctgtggaggagggcagtcccgttgtctttaggggaaggggtgcagtaatgaaaacagaacactcccaatcccacccctcccagggaaggagggctagagaaccaacgcgcgggagagggcgccctgggattcactggcattcgctctgtcccggccaggtgtcctggaacgcggccgggcgggcacttagccagttacctgaacgcggacaggtgagctcgggagggcccagcctcagcctggcaggggaagttttggccctctgactgtcctgcacctctcagctacatgttcaggacccgggcaggctgaggcaggcgacgcatacggatgcacacactcagactgtgttgcacacgcacactttcttttttgaattcacgctatct

SEQ ID NO: 129583 - DNA, 748 bp, Homo sapiens
  chr8:69244031-69244779
  Hyper
ttttttttttttttttaatgagggcggtaatagaacccgaaaaggtggaggaggtgcttagcagttaatacaattaactggaagacagctgaactggtgaggagtaggcttcagtcggtgcgggcgtgatgaatgaaattggcaaactgagagactgccatttggtcactggacgaaaggagagtcctttgcactgcagaccccacatgtgttagcaggagaaagggacggagaaaggttctgaaaagcacacacgtatttgtggaagaagactatagctctgagctggttttgtttttttttctctctctcgccattaaagaatttaagacaaaaatacagtagaaggaagagcgcgaggacacgagaaaatgagaacaagagattgaagcctggcaccagcaaagcgtcccgcgggttgccagggtgctgagcaggggtggggcgtgcggaccgtagtcagaagtggaggcccttgcggagggactcccttggtcccatccagttcagggggcactgaccggcggcgagagttcgcgggagggtcgaggtgctcccgccttgcccccgccttgcccccgccttgcccccgccccccacgtctcccagaagcagttgtagctgttcttaacagcttggtttggggtgagggcttggtatggggaggaggttacgtgtcagtgtctgagagaggcagaatcgcggcaagtggaaggggctgcactggagatcgcggaaaacctagcaa

SEQ ID NO: 129584 - DNA, 414 bp, Homo sapiens; identical to SEQ ID NO: 99757
  chr8:70404780-70405194
  Hyper

SEQ ID NO: 129585 - DNA, 143 bp, Homo sapiens; identical to SEQ ID NO: 99758
  chr8:70412954-70413097
  Hypo

SEQ ID NO: 129586 - DNA, 30 bp, Homo sapiens; identical to SEQ ID NO: 99759
  chr8:70571296-70571326
  Hypo

SEQ ID NO: 129587 - DNA, 521 bp, Homo sapiens; identical to SEQ ID NO: 99760
  chr8:70744803-70745324
  Hyper

SEQ ID NO: 129588 - DNA, 57 bp, Homo sapiens; identical to SEQ ID NO: 99761
  chr8:70785966-70786023
  Hypo

SEQ ID NO: 129589 - DNA, 23 bp, Homo sapiens
  chr8:70842992-70843015
  Hypo
aatactactcttggccgggcgca

SEQ ID NO: 129590 - DNA, 80 bp, Homo sapiens; identical to SEQ ID NO: 99763
  chr8:70847246-70847326
  Hypo

SEQ ID NO: 129591 - DNA, 184 bp, Homo sapiens; identical to SEQ ID NO: 99764
  chr8:70945287-70945471
  Hyper

SEQ ID NO: 129592 - DNA, 972 bp, Homo sapiens
  chr8:70946686-70947658
  Hyper
tgaaaagagaaaacacgtagacataatctggatggcggagactgaagagtgattatctctaggtggctggatgctgggtataggttggccgcaatgttatttttgtaaggctaggagaaaaacgttattttaaatatacggaatttgctcctctccaaatccactctccctttcgcctccctagaggttgtcaggttcaagaagcggcccggagttgcaggaagggcgccggcgtcactggccccaagagctcggaacgcgcgcgccgcaggagtgccggctgcggggtcgggttgagactggcgggaccctcggcctctgccggggtgcggaaggtggatgctacgggcaaaggggcggggcttgcggttcccagatccagaggcgggttggggacgtgagccggcgtccatgtgttctgcaccccttctcgcccggtgcctctctcaaggcacgttttccaaagtgtgttgaattcgggaatcgatcgaaaatttcaaggccaattaaatgccctctgatgtagagctccgattaggcccgaaaggcttcaaacagcccctctagaccctcgagggtcttcgccgcggtaaccttaggcgtcccctccccgagaagtctccctgaggctttcacagagggcgggaggggctgcgctggggcctccgttcccagtgcccctgactggtggggagggatggccttagtgtctgagagcagagaccagattgactcccacttgagaccagaaaacgaagaggaagcggaacccgaggtggctgcggctcccccgggacacaaccgggagaggaagtcctggccatctgccggccccgcctgggggcatctgctcgaggatccctgggagccgttatcgtattcctcagaatctgccgtgctgtccctccgcccccaaaaccaacaggacacccattctgtgattctcttcttctccatcgcccagttggaggc

SEQ ID NO: 129593 - DNA, 3280 bp, Homo sapiens
  chr8:70981714-70984994
  Hyper
ttcactgctggcacccgcgtactcgtggctgctgctcaggaagggcggcacttccctggggacgtggggaattgggtaccacggtggcagcttgctgtaccagggcagatcgtagagaggctccctctgtaggcccagacccgggctcagcaagggaggcgccatccggaaggggaaggggggcatggcgggggcagcagacgctgcggcctccagctgccggaaaggttggaagtcttcctccacggtggccaggctgtttctgtagtgtccataggacgggaaaggcgtgtagtacgcggccaggttctgcgggctgctctccggcgggtagcacaccttgtcctgaggcacggcctcacttggccggggtagagccatcccgggaccgcacgctcggcggctctgcagaaaagcgggcgccgctgaggacaccgcgcgggagcttcccggggtccgacccgcgcctccccaccagcctcctccaccccagccagccccagatccaagggaacaggataaacgcccccagtccgatcccgccagcccgctcccacaattaagacaaaacgaaaaaacagcaatagaagcaaacacaaaaaagccccaaacggaaatctgccgggatcctgccctactctaaattccgggttagtgttgccttccccttccctctccaagcaccccttccctaagcccggccgccttcccacacccgctctccgctttcggcccccaacccggttcctgcaaaacccattgaagttccctttccttccttcttctcagtcctacaaaactcgttggtagggtctgtgggagccgcggggccctgccaacctcggggctgggccgggagccgagcgcaggcggtcggagggcaatggagcaagcgacagctccaggcgctcctgggccctcggctgggagggaagagccgaggaccctgggtcgcaccgcgcagatggagacgcgctcccagagcccccgggcaggtccagggaccccgcgacctgctctggcccagcggtgtgaccccgcgggtcctggcggtcctgactgcccgcaggggaggggcgcgccacttttggctgccctaggatgcgccgcctgaacctcttttccctcgcgggcagcgtccgccacattccccgggttcctcggaaactccaatcattctaccaggactattggggcctggggtagcccctcgggagccgcgtggacgagccctggccaggtgggagcgaagagcctcggcgactgccagtcctcccgcccccgcaccgccgggaaaggatggcgttttaatagacaggcagcaagttcaccgaggctgaagaatgaagccccttcagggccggcgggtcttgagatcaatgagcccaataagaaaaccaagcagggtcatgactcagaaattaaagaacacggggtcaggagaagaggtcagccacgacacaggcagcggcccgtctcctcccgatcctccaaaggcgcccttctcctagcctcctccgacctcagggatctgcaacttgggattcaaagcccccgagagggcagaacgaccatccaaaacgaactgcgccagcgagtgctgccgccctccccaacggccctggaagaccaccgccccgggccccaggcgcgtcctgtcccgtgcctacctccgacaccacctccaagagcgccaccgcggagcgggcgcctcctggacgctgcggggccactcgggctcggtaggccactcgggctcggtagacttcgggcgggccctgagggctgagccaggcttaagagggcgggcggggccgcggggcatcgacaggtcgagggtagggaattgacccggcccacgcagatccccgcgtcgtcttctccccgcccaccgcagccattggccgactctcgactcgccctctgtcccctggggtcgctcacttaactcatcagttttccaaaccctccctgggaccctagtggcgagcactcgccgctggccttctagggcaggcagtattgccgctccaggcgtgcggagtcggggagaaaaaaaccgaacacgtgtgctacccagggcccccagataagcccctccgcgcgcacacacaccctgaaccggagtccagaaggccggactcgcgtcccggggtcgagccccttactctccgctcccagttcggaagatcccagcctgcccgaaggcggcgtctgacccgctggtggacctggtgggtgtctgttcctgatacctggggacgaggcgggagcgccttgagcgctgggaagcttcgcctcgcgagtccccggcagtgacacgtgggagcgttgggcccggcacccccgacgcttccgaggtttcgggtggtcgttttgctctctcgggggcttttattccttaagtggctttaaacgaccgaggatgggcctcccgcgccgccgcagctgtcacttccttcgggaaaggctagcgaccttggacgcgcaggctctgaaaaccaaggtccagacccataccgagcgcccaaagaccgcatttgaattctcctcgccggccattgagggagagaaaggaacgcttagttccattcacattcacagaaagaagcgccgagggtgggggaaacgcagtcttgccgggtgagccgggacaggttcctcgcctgccccccggccgctgcttcctcttagctgaatggggagcgacccgccccgggcgcggccttcggggctgaagactgaggtgcagcctcacccccggcctggcagcggcttggaagagagagggaaaggaggaacatctacccggctaagagacgccgccagagtccctaaagctggcgggggacggaggccggggtcccggatcttcagagcgcccgcagccgggcttctgggctcctcggtgcggggaacctgaccctgtagccttcgccagggcgcggcggggctgcaagaagggaggaaggagtgggactagagccttcgagggcgcgggcggcgtgcactcagccttgtctccccgcgcgccctgccgcctgcttgccccctttgctgcaccgggtggccctggtccccgcgcccgcccgcccccgacgccttcgcgtggttccgcgctgcccgcggccagccccgtttcgcttcgcaaggagcgtgttgttttctcaatcgaaatgggatcaagatcccagggtttcctcgtctccttgttttgaggtgataggatcttagccaatagatcgaaaacgtgaaaagtacccgtcgcctcttgtcccaa

SEQ ID NO: 129594 - DNA, 240 bp, Homo sapiens; identical to SEQ ID NO: 99774
  chr8:71017239-71017479
  Hypo

SEQ ID NO: 129595 - DNA, 45 bp, Homo sapiens; identical to SEQ ID NO: 99775
  chr8:71115137-71115182
  Hypo

SEQ ID NO: 129596 - DNA, 30 bp, Homo sapiens; identical to SEQ ID NO: 99776
  chr8:71240462-71240492
  Hypo

SEQ ID NO: 129597 - DNA, 213 bp, Homo sapiens; identical to SEQ ID NO: 41821
  chr8:71368455-71368668
  Hypo

SEQ ID NO: 129598 - DNA, 37 bp, Homo sapiens; identical to SEQ ID NO: 99778
  chr8:71448087-71448124
  Hypo

SEQ ID NO: 129599 - DNA, 30 bp, Homo sapiens; identical to SEQ ID NO: 99779
  chr8:71522730-71522760
  Hypo

SEQ ID NO: 129600 - DNA, 30 bp, Homo sapiens; identical to SEQ ID NO: 99780
  chr8:71582179-71582209
  Hypo

SEQ ID NO: 129601 - DNA, 402 bp, Homo sapiens; identical to SEQ ID NO: 99781
  chr8:72273868-72274270
  Hyper

SEQ ID NO: 129602 - DNA, 938 bp, Homo sapiens
  chr8:72459598-72460536
  Hyper
cgaaggaaaacaaaccggcccttgacacatccctccacgtgcagcgcccgacgccacgggccttgggcggctgcacctctcccctgccggccacggctcaaggccccattattgcgcgcacccagctcccttccaggtgactttcgcgtacctggcggcggcgccctaggcctcggaggctgcccgggcgggctggggctcgggcggcgctcgctgagagtcgcggcgcccctcagccgcttcccgggcgccgatcgccgccctcctgccccggggtggggcccaggggcatcagcagccgcgggctctcggccgccgcctgggaactcagggtcagatttagtttcacaacaacgtctcctcgtcacggcaacccaactggaggcagaagccggcggggcggccgagcggggcggggcgggagcgcggccgccgcgagccacggtggggagcgggcgcgggggaccctggcgggccccgggcagcgcggctgcacttacttgtgtcacaactgcggcgacggggggctgaggaaccggttcttccaaaagcaaaccgaaaatgggtaacagagaggccggggcagcgctaagaggggttctgcctcggtgtttagggcaaaaaacccggctccggcttccagaaattcgagccagcggtggctttttctttctttcctctctaaacgctcctgtgcctccgggtcgaggggcgcccttcgcgcggctccgagtgcacagcgacaccagggctggcgctggagaggggagccctcttcccagcacccctcgggtctcccccgtacccccacccacagcccctttcctgggcccgacgcccctccgctctgcagccggagcctgggcctggtgcccactgccccgcggggtgtctcggacgcctggcccctgcagcgttttctacggagaggcctcaga

SEQ ID NO: 129603 - DNA, 30 bp, Homo sapiens; identical to SEQ ID NO: 99783
  chr8:72466268-72466298
  Hyper

SEQ ID NO: 129604 - DNA, 1020 bp, Homo sapiens; identical to SEQ ID NO: 99784
  chr8:72468554-72469574
  Hyper

SEQ ID NO: 129605 - DNA, 499 bp, Homo sapiens; identical to SEQ ID NO: 99785
  chr8:72470336-72470835
  Hyper

SEQ ID NO: 129606 - DNA, 79 bp, Homo sapiens; identical to SEQ ID NO: 99786
  chr8:72471116-72471195
  Hyper

SEQ ID NO: 129607 - DNA, 930 bp, Homo sapiens
  chr8:72754310-72755240
  Hyper
cagcggccttcctcccgcccgttagaagggcgctgtgctggagtacgaacccggcccagagaagccactcgcccttctttgtcacttaaaaccctgtcccgacgcggatctcacgtctagacctctgtctttaaagcggatgtagagcgcgttctaaccgttccctaaccattgtgtcaccgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgag

SEQ ID NO: 129608 - DNA, 1649 bp, Homo sapiens
  chr8:72755300-72756949
  Hyper
acacacacacacacacagtcatccactccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccggcgcccaggagcgccctgggtatctcctggctgctctcccgaatccttgcgcgccgcgcccctaccaggttcactgggtgcacgtagccgttctcatagcggtcctcctgcaacagctgccgcaggtgagcgatgtaactggaagccagccggagcgtgtccagcttggagagcttagtgtcggggggcacccagggcaggctggtcttgagcctggagaaggctttgctcagcacgcgcatccgggcacgctcacgggcgttggccgcgttccgctgcgactgcttgcactctgcggctgagcccttggccgggaggggcttcttgccaccaccgcccgcgctaccacctgcgccgccgcccccagccacacggggccgcttcctcttgcagccttccgcgctgccggctgtgcccagagcgcagcgctcctcctcgccgtcggggtcctcctcctctgccgacgagttgtcactgggcgaggcgtagctgcgctctacgccgcggaggggcggcctcttggaggcggggaccgggtactcccgctgcagcccccgaagctccatctcctccggatcactcaccgagcccgtggacatcccgttgtcccccttgcccacacgcgtcctctttcctcccccctggccagtctcgctgtctccgccttccgctccctggcggaggcggaggccagagagcgctccaaggaagactaaaaacccaggccgggaagcgcggggtgagaaagcgaggtgggtggcgagagcgtgagcgcccctctgctgaccccggggagcgtggactacgagttggcgcccaagtccagaatccgcgcgcaccgcggtaagctgcgccttttgaaaaggctatctgtactccttggaacaaaccaccccgggcaaagaagagggggttgtaaagggggccaagaggtggggcaggggcgtggaaggggtggggaccgcttttctgcatgccgaagagcggttggtggaggcgggggaaggggacgtctctgcagagccgagatttgggctctgaagcccgacggcccttcaacatgtctgcgcaggataagtgagctttcggggagtgaaggggcacatcttgttcctaccgacggtgcttctacccc

SEQ ID NO: 129609 - DNA, 30 bp, Homo sapiens; identical to SEQ ID NO: 99792
  chr8:72782820-72782850
  Hypo

SEQ ID NO: 129610 - DNA, 30 bp, Homo sapiens; identical to SEQ ID NO: 99793
  chr8:72855159-72855189
  Hypo

SEQ ID NO: 129611 - DNA, 96 bp, Homo sapiens
  chr8:72917369-72917465
  Hyper
tcaaggcttgcaggtcgtctccaggagtcagagaggtccggactccggggattcctgctccgcggagaactggggagcccccgttcctgtgccact

SEQ ID NO: 129612 - DNA, 30 bp, Homo sapiens; identical to SEQ ID NO: 99795
  chr8:72917679-72917709
  Hyper

SEQ ID NO: 129613 - DNA, 494 bp, Homo sapiens
  chr8:72987542-72988036
  Hyper
ttccttgaaatcctccgtgtcgtccggcacatcctcatagacaacgccctggggctccttcttttctccagggcgccacatcttcctcaggctgcgcttcattgaccccaccccggacgccacctggtgcagctgctcaccacgcgcgcgggcacctggggcgagagagcgctgtcagcctgccaggcgctggggtccgcgcgagcccgagctctcccgcgctgcagctcacaggcagcgaaaaagtcgctctgcggaagccctggagaacttctggaaggagttctcaggcccgcgctacttttgtagtgcaggaagcaggcggggcgcggagaggaggtagaaacgcggagctccttcgcaaagagggcggcggcgccgcgtctgccttggactcgccccttcagggacaaagtgactcgcccgtcccgctgtcctgcagctgcagcagcgcactgacggagtcaagcgtgtcaggtcggggtggattgcag

SEQ ID NO: 129614 - DNA, 747 bp, Homo sapiens
  chr8:73163497-73164244
  Hyper
aatagataaagcaggcgctgtgtgggcgcgtcattagcggggtctcctcttggactgtgaacacaccccaaagcttgcaaccccctggccactccacgctttctccaaaccaagggctgcccgcaaggaaacctcgagccgaaccgcggccggacttcagaacccgtcccgacccgcgaacccccagggtaccttaagcggttccttgcagtcctccgtgtcgtcccgcacatcctcatagacaacgccctggggctccttcttttctccagggcgccacatcttcctcgggctgcgcttcattgaccccaccccggacgccatctggtgcatctgctccccacgagcgcgggcacctggggcgagagagcgctgtcagccggccaggcgctggggtccgcgcgagcccgagctctccctcgctgcagctcacaggcagcgaaaatctcgctccgcgagagccctggagaacttctggaaggagttctcaggcccgcgctacttacagtgcaggaagcaagcggggcgtgaagaggaggtagaaacacagacctccctagcaaagagggaggcggcgcagcgtctgccgaggactcgccccttcaggaacaaagtgactcccccgtcccgctgtcctgcagctgcagcagcgcactcccagagtcaagcgtgtcaggtcggtgtggatgcagcgaatttgttgtaatctacacattaagagcccccttgcctcgccctgccccctcc

SEQ ID NO: 129615 - DNA, 46 bp, Homo sapiens; identical to SEQ ID NO: 9640
  chr8:73448786-73448832
  Hyper

SEQ ID NO: 129616 - DNA, 30 bp, Homo sapiens; identical to SEQ ID NO: 32100
  chr8:73449084-73449114
  Hyper

SEQ ID NO: 129617 - DNA, 55 bp, Homo sapiens; identical to SEQ ID NO: 99802
  chr8:73449377-73449432
  Hyper

SEQ ID NO: 129618 - DNA, 523 bp, Homo sapiens
  chr8:73449639-73450162
  Hyper
ctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagccggggagaccctcctctctgtggaggggagggggatttccagcgacaggtcattggcgaaggggatcgtcgcggggagaggctccccggagggagcggggaatcccacagccctttgtggtgcccgagcccgtgccgcctgctgagcggggtctgtgggagctaggtaagtggcgggggcattgctgctccccgaagggggtcttcc

SEQ ID NO: 129619 - DNA, 119 bp, Homo sapiens; identical to SEQ ID NO: 99805
  chr8:73450471-73450590
  Hyper

SEQ ID NO: 129620 - DNA, 218 bp, Homo sapiens; identical to SEQ ID NO: 99806
  chr8:73802558-73802776
  Hypo

SEQ ID NO: 129621 - DNA, 18 bp, Homo sapiens
  chr8:73966731-73966749
  Hypo
aagcgttgagtcaccgcg

SEQ ID NO: 129622 - DNA, 113 bp, Homo sapiens; identical to SEQ ID NO: 99808
  chr8:74005057-74005170
  Hyper

SEQ ID NO: 129623 - DNA, 30 bp, Homo sapiens; identical to SEQ ID NO: 99809
  chr8:74005509-74005539
  Hyper

SEQ ID NO: 129624 - DNA, 34 bp, Homo sapiens; identical to SEQ ID NO: 99810
  chr8:74086196-74086230
  Hypo

SEQ ID NO: 129625 - DNA, 46 bp, Homo sapiens; identical to SEQ ID NO: 99811
  chr8:74332799-74332845
  Hypo

SEQ ID NO: 129626 - DNA, 54 bp, Homo sapiens; identical to SEQ ID NO: 99812
  chr8:74674435-74674489
  Hypo

SEQ ID NO: 129627 - DNA, 101 bp, Homo sapiens; identical to SEQ ID NO: 41825
  chr8:74759410-74759511
  Hypo

SEQ ID NO: 129628 - DNA, 44 bp, Homo sapiens; identical to SEQ ID NO: 41826
  chr8:74759819-74759863
  Hypo

SEQ ID NO: 129629 - DNA, 30 bp, Homo sapiens; identical to SEQ ID NO: 99815
  chr8:74848031-74848061
  Hypo

SEQ ID NO: 129630 - DNA, 157 bp, Homo sapiens; identical to SEQ ID NO: 99816
  chr8:74962845-74963002
  Hypo

SEQ ID NO: 129631 - DNA, 37 bp, Homo sapiens; identical to SEQ ID NO: 99818
  chr8:75232634-75232671
  Hyper

SEQ ID NO: 129632 - DNA, 160 bp, Homo sapiens; identical to SEQ ID NO: 99819
  chr8:75232938-75233098
  Hyper

SEQ ID NO: 129633 - DNA, 57 bp, Homo sapiens; identical to SEQ ID NO: 99820
  chr8:75233984-75234041
  Hyper

SEQ ID NO: 129634 - DNA, 34 bp, Homo sapiens; identical to SEQ ID NO: 99821
  chr8:75733579-75733613
  Hypo

SEQ ID NO: 129635 - DNA, 840 bp, Homo sapiens
  chr8:75896554-75897394
  Hyper
cacgcccacaaaggccgagcgccctggcttcgctgcgttccggagaagcagggcgggctgcttctcccggatctggcgggcctctggccacggctggttggaggtgggggtgggcgaggaggggcgctcaagtcacgtgcccgcgctggggccgcaataaatgctcgcgaacgcgagagagcgacggaagcgctaggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagaggtaagggcgattctaaaatgcatcgctgagtcgtcaagctgccaccctttcctatctccctttgccttcttaaactgtacttaaaaaaaaaaaaaagccaactgtacagagtggttgggcgcgatgggtgggtgggctacccggaaagcagcgacgatagaaattagcgggagctctagttcttgtaagtgactttgttggtttcacctactttctctgtcgcgcgctttccatttgag

SEQ ID NO: 129636 - DNA, 87 bp, Homo sapiens; identical to SEQ ID NO: 99825
  chr8:76008456-76008543
  Hypo

SEQ ID NO: 129637 - DNA, 692 bp, Homo sapiens
  chr8:76316303-76316995
  Hyper
gtcccagttgcagtccgctattgctccaggcccagcgggggcggacctcgttggaggctacggtgcaggtcggagaagatgaaatggcctagcatcccccttcccaggggctcgagtcggcagctttagagctccgacaatctgtgccctcgctttgggctgcgccagggagcaaaaaacctctgcttttttgaaagaggccggggcaacaaggtagagagccgcggccagaagcagccccgggccataaacccgaggcctggatggcttaaggctgaaaccgcctccgcccccaccctcaccctgctggccgagccctcccccctcctagccacagtgaccggaatcccagacttcccttctgatgcataaaacattcagtggcctccagggagtttttgaaattctggcggaggctgctttatccgttgtttcgccccctgggtcaaacactggtccactgggtgagttggaggagcgagtagctcagctatagattaaatttaacctgagccccggtggccgcgtcccgcccgcggtcctttctatacgagtagctttgaaggtgtcaccgagctgtgcccaaatctagaaaagaatgggaggagaactgcatgagcttttaattttcttccctttttccccccttcctgcgtgtaaactggggtaagggtgggcggtaatccccactg

SEQ ID NO: 129638 - DNA, 64 bp, Homo sapiens; identical to SEQ ID NO: 99828
  chr8:76319856-76319920
  Hyper

SEQ ID NO: 129639 - DNA, 56 bp, Homo sapiens; identical to SEQ ID NO: 99829
  chr8:76320236-76320292
  Hyper

SEQ ID NO: 129640 - DNA, 30 bp, Homo sapiens; identical to SEQ ID NO: 99830
  chr8:76836378-76836408
  Hypo

SEQ ID NO: 129641 - DNA, 23 bp, Homo sapiens
  chr8:76861290-76861313
  Hypo
ccagacgcggtggttcgcaccta

SEQ ID NO: 129642 - DNA, 1618 bp, Homo sapiens; identical to SEQ ID NO: 99832
  chr8:77585073-77586691
  Hyper

SEQ ID NO: 129643 - DNA, 30 bp, Homo sapiens; identical to SEQ ID NO: 99833
  chr8:77586986-77587016
  Hyper

SEQ ID NO: 129644 - DNA, 606 bp, Homo sapiens; identical to SEQ ID NO: 99834
  chr8:77590098-77590704
  Hyper

SEQ ID NO: 129645 - DNA, 2320 bp, Homo sapiens
  chr8:77593174-77595494
  Hyper
gtttgtgtgtaagagcgcgtgtgtgtctaatgaagtttgggagtcgcgcgcaggggcgcgtagggtgcgagacccggaggtccccatcccctgtcctctccgcggtcgccgcatccggggctccagccgcagcgctgggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtaagttttttctttaacttttattgagtagtttctgttaaatttaggtcgagtatcgattatctttccagcctgatcttgcacaatctttgatatttcgctccctctctctccctctccgcctctcttcctctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttcgtgagctctggggaggggattccaagaggctggggtgaacgctggggctggggctgcaggtagacacccgcccaccggagcgggcgcggcaggcactaccgagggctgctctcggcggcgcgggcgcgggcgccgcggaggaaaggcaggtccgttaggaggcgggatcgcccggcctctgggccagggacccgcgaggcggcggctgcttgctccgaacggaacgccgccgggtgtgcgttagaccagcggatagacgcccgcggcttggggtcaagaatcttttcctttttagcaaagggcaaggggtgtgtgcgtgtgcgtgtgcgtgtgtgtgtgtgtattgagtggctgtgttcggctgtgagaaccgattcattcttcggcccccctaaaagggttccatgcctacaaatgaacttcacctccttcgtttctccaagcatcaagtgcgccttctggctgggagcagctaagggaaaagggactggaatgcgccgggtctctccttccttctacttctatccacccccaacccccttctcgctcctcttttctatcagaaaaaaataataaaatctctcatggaattgtataaagtttctctgccgatgtccaagttacagaaggttccctattctaatccccttcccctagaagacggtgcactggtttctatttcttttgttacctgtgatccgggcggggggctcctttcggccgctcgggctggggtccggcccagagaggaggcttctgcgggcgcctttggccgcgacttctcacttccgcgcggttctggtgaggttttagctaccgttcggtgagacaccctccttgtaggtaccaaaggttcagatcgcaaacacggaccccccccacctcgacccctacacaca

SEQ ID NO: 129646 - DNA, 30 bp, Homo sapiens; identical to SEQ ID NO: 99839
  chr8:77595977-77596007
  Hyper

SEQ ID NO: 129647 - DNA, 415 bp, Homo sapiens; identical to SEQ ID NO: 99840
  chr8:78532894-78533309
  Hypo

SEQ ID NO: 129648 - DNA, 759 bp, Homo sapiens; identical to SEQ ID NO: 99843
  chr8:79428289-79429048
  Hyper

SEQ ID NO: 129649 - DNA, 30 bp, Homo sapiens; identical to SEQ ID NO: 99844
  chr8:79674707-79674737
  Hyper

SEQ ID NO: 129650 - DNA, 30 bp, Homo sapiens; identical to SEQ ID NO: 99845
  chr8:79844975-79845005
  Hypo

SEQ ID NO: 129651 - DNA, 30 bp, Homo sapiens; identical to SEQ ID NO: 99846
  chr8:80086720-80086750
  Hypo

SEQ ID NO: 129652 - DNA, 162 bp, Homo sapiens; identical to SEQ ID NO: 41828
  chr8:80483857-80484019
  Hypo

SEQ ID NO: 129653 - DNA, 664 bp, Homo sapiens
  chr8:80523889-80524553
  Hyper
attgcaaagtcaaagcggtcccatcccgctgtttgaaagatgggtggagacggggggaggggatggagagaactgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgaccccgccctccccacgctggcctcattgttctgcttttaagagagatgggaaaagtgggttaacatttttcttttcggaagcaaattaca

SEQ ID NO: 129654 - DNA, 928 bp, Homo sapiens; identical to SEQ ID NO: 32123
  chr8:80524845-80525773
  Hyper

SEQ ID NO: 129655 - DNA, 38 bp, Homo sapiens; identical to SEQ ID NO: 99851
  chr8:80677743-80677781
  Hyper

SEQ ID NO: 129656 - DNA, 30 bp, Homo sapiens; identical to SEQ ID NO: 99852
  chr8:80695916-80695946
  Hyper

SEQ ID NO: 129657 - DNA, 30 bp, Homo sapiens; identical to SEQ ID NO: 99853
  chr8:80696233-80696263
  Hyper

SEQ ID NO: 129658 - DNA, 572 bp, Homo sapiens
  chr8:80803328-80803900
  Hyper
ttttccttgtcaatacgaaaatctttgagtacaaatcgataaagctagagattcaaagactgcctttataaaactggagaagatgcactctggccataggcggagggggcagcccggggcccctgtcaggaagccaagcggcccggggcatccctggaaggctgccgagggggcagcgccttctctggggacggcttcgtggagagtccgggacgggcgagacagaaaaccgagccctatttgttattagtatttttttttttatactctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgccgctttcccaggccgccaggggtgaggaggtgacgctgcgggcttggtggcggctggtttttcacacaggaatcctcctcgccaccgctccctcgaaggccgccccccgctccacccccagc

SEQ ID NO: 129659 - DNA, 30 bp, Homo sapiens; identical to SEQ ID NO: 99855
  chr8:80804344-80804374
  Hypo

SEQ ID NO: 129660 - DNA, 96 bp, Homo sapiens; identical to SEQ ID NO: 99856
  chr8:81051849-81051945
  Hypo

SEQ ID NO: 129661 - DNA, 35 bp, Homo sapiens; identical to SEQ ID NO: 99857
  chr8:81052005-81052040
  Hypo

SEQ ID NO: 129662 - DNA, 30 bp, Homo sapiens; identical to SEQ ID NO: 99858
  chr8:81084313-81084343
  Hypo

SEQ ID NO: 129663 - DNA, 20 bp, Homo sapiens
  chr8:81085073-81085093
  Hypo
aaaacaggcctggcacggtg

SEQ ID NO: 129664 - DNA, 38 bp, Homo sapiens; identical to SEQ ID NO: 99860
  chr8:81213318-81213356
  Hypo

SEQ ID NO: 129665 - DNA, 38 bp, Homo sapiens; identical to SEQ ID NO: 99861
  chr8:81309040-81309078
  Hypo

SEQ ID NO: 129666 - DNA, 101 bp, Homo sapiens; identical to SEQ ID NO: 32125
  chr8:81400332-81400433
  Hyper

SEQ ID NO: 129667 - DNA, 398 bp, Homo sapiens; identical to SEQ ID NO: 99863
  chr8:81478129-81478527
  Hyper

SEQ ID NO: 129668 - DNA, 70 bp, Homo sapiens; identical to SEQ ID NO: 99864
  chr8:81786854-81786924
  Hyper

SEQ ID NO: 129669 - DNA, 1074 bp, Homo sapiens; identical to SEQ ID NO: 99865
  chr8:82192624-82193698
  Hyper

SEQ ID NO: 129670 - DNA, 193 bp, Homo sapiens; identical to SEQ ID NO: 99866
  chr8:82543083-82543276
  Hyper

SEQ ID NO: 129671 - DNA, 219 bp, Homo sapiens; identical to SEQ ID NO: 99867
  chr8:82556628-82556847
  Hypo

SEQ ID NO: 129672 - DNA, 30 bp, Homo sapiens; identical to SEQ ID NO: 99868
  chr8:82687586-82687616
  Hypo

SEQ ID NO: 129673 - DNA, 90 bp, Homo sapiens; identical to SEQ ID NO: 99869
  chr8:82903043-82903133
  Hypo

SEQ ID NO: 129674 - DNA, 52 bp, Homo sapiens; identical to SEQ ID NO: 99870
  chr8:83104515-83104567
  Hypo

SEQ ID NO: 129675 - DNA, 91 bp, Homo sapiens; identical to SEQ ID NO: 99871
  chr8:83281998-83282089
  Hypo

SEQ ID NO: 129676 - DNA, 38 bp, Homo sapiens; identical to SEQ ID NO: 99872
  chr8:84342394-84342432
  Hypo

SEQ ID NO: 129677 - DNA, 340 bp, Homo sapiens
  chr8:85094516-85094856
  Hyper
ggctcccgcggggtgcgccaccgcctcactgctggtacacgtctccccctctcgaccgccaagtgcttgctccctccaggcgagcactcacacaatggactcacttgtttcccatgcccctctcctttgacttccagcctcagcgaacaacttgagcaagagtcaaacaggagtctctgccatggagcatagacccttggagctttccagaccagctcagaagcacgggcgcacacacagacaaaacaatgccttgtccacgaatgaataaaggacacccatgcccccacccaccgctccgcaacccgcagaaagaaacccgggacggggtttcctaaat

SEQ ID NO: 129678 - DNA, 452 bp, Homo sapiens
  chr8:85095259-85095711
  Hyper
cacctcctctcaaggcgctggatcagcacccctgagctgcccccacagcacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcgtgaggggcacctgctcgtctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctga

SEQ ID NO: 129679 - DNA, 133 bp, Homo sapiens; identical to SEQ ID NO: 99876
  chr8:85095983-85096116
  Hyper

SEQ ID NO: 129680 - DNA, 199 bp, Homo sapiens; identical to SEQ ID NO: 99877
  chr8:85096522-85096721
  Hyper

SEQ ID NO: 129681 - DNA, 439 bp, Homo sapiens
  chr8:85096781-85097220
  Hyper
gtccgagcccgaggtggggagagcggcgcagggagccagggaaaaccaaagtccgttccctgcttcaggatcgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctccgagggccacttgcacagcaggaggggcgagggccgtgtacgtggcgctggccgtcgggcgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgct

SEQ ID NO: 129682 - DNA, 19 bp, Homo sapiens
  chr8:85844268-85844287
  Hypo
tttgagacaaagtctcgct

SEQ ID NO: 129683 - DNA, 30 bp, Homo sapiens; identical to SEQ ID NO: 99885
  chr8:86034879-86034909
  Hypo

SEQ ID NO: 129684 - DNA, 103 bp, Homo sapiens; identical to SEQ ID NO: 99886
  chr8:86301028-86301131
  Hypo

SEQ ID NO: 129685 - DNA, 30 bp, Homo sapiens; identical to SEQ ID NO: 99887
  chr8:86350528-86350558
  Hyper

SEQ ID NO: 129686 - DNA, 114 bp, Homo sapiens; identical to SEQ ID NO: 41831
  chr8:86370822-86370936
  Hypo

SEQ ID NO: 129687 - DNA, 199 bp, Homo sapiens; identical to SEQ ID NO: 99889
  chr8:86389517-86389716
  Hypo

SEQ ID NO: 129688 - DNA, 29 bp, Homo sapiens
  chr8:86405563-86405592
  Hypo
tgcacgggggatgggcgcggtgcctcaag

SEQ ID NO: 129689 - DNA, 36 bp, Homo sapiens; identical to SEQ ID NO: 41834
  chr8:86406813-86406849
  Hypo

SEQ ID NO: 129690 - DNA, 26 bp, Homo sapiens
  chr8:86417676-86417702
  Hypo
agaatcacaagcgtgagccactgtgc

SEQ ID NO: 129691 - DNA, 30 bp, Homo sapiens; identical to SEQ ID NO: 99895
  chr8:86428565-86428595
  Hypo

SEQ ID NO: 129692 - DNA, 30 bp, Homo sapiens; identical to SEQ ID NO: 99896
  chr8:86432229-86432259
  Hypo

SEQ ID NO: 129693 - DNA, 123 bp, Homo sapiens; identical to SEQ ID NO: 99897
  chr8:86436621-86436744
  Hypo

SEQ ID NO: 129694 - DNA, 42 bp, Homo sapiens; identical to SEQ ID NO: 99898
  chr8:86437022-86437064
  Hypo

SEQ ID NO: 129695 - DNA, 128 bp, Homo sapiens; identical to SEQ ID NO: 99899
  chr8:86468333-86468461
  Hypo

SEQ ID NO: 129696 - DNA, 76 bp, Homo sapiens; identical to SEQ ID NO: 99900
  chr8:86495755-86495831
  Hypo

SEQ ID NO: 129697 - DNA, 120 bp, Homo sapiens; identical to SEQ ID NO: 99901
  chr8:86544680-86544800
  Hypo

SEQ ID NO: 129698 - DNA, 63 bp, Homo sapiens; identical to SEQ ID NO: 99902
  chr8:86556050-86556113
  Hypo

SEQ ID NO: 129699 - DNA, 74 bp, Homo sapiens; identical to SEQ ID NO: 99905
  chr8:86849567-86849641
  Hypo

SEQ ID NO: 129700 - DNA, 19 bp, Homo sapiens
  chr8:86926063-86926082
  Hypo
accacgcctggctaatttt

SEQ ID NO: 129701 - DNA, 30 bp, Homo sapiens; identical to SEQ ID NO: 99907
  chr8:86953049-86953079
  Hypo

SEQ ID NO: 129702 - DNA, 221 bp, Homo sapiens; identical to SEQ ID NO: 99908
  chr8:86976079-86976300
  Hypo

SEQ ID NO: 129703 - DNA, 212 bp, Homo sapiens
  chr8:87081740-87081952
  Hyper
ctcgggcccaggccccgcgcctccgacgccggcttggttttgaccttcgtgcttggcccaagccagcgctggtggccccgggaccaccttcctgctggcgccgcaccccatacccgcaacacgcccgccgctcgcgggacctggggactcgggaagcagccagccccgttcctccgccctttatcaaagagcagctgcgaggggcgggaccc

SEQ ID NO: 129704 - DNA, 197 bp, Homo sapiens; identical to SEQ ID NO: 99910
  chr8:87083708-87083905
  Hypo

SEQ ID NO: 129705 - DNA, 32 bp, Homo sapiens; identical to SEQ ID NO: 99913
  chr8:88037278-88037310
  Hypo

SEQ ID NO: 129706 - DNA, 498 bp, Homo sapiens; identical to SEQ ID NO: 41839
  chr8:88885698-88886196
  Hypo

SEQ ID NO: 129707 - DNA, 941 bp, Homo sapiens; identical to SEQ ID NO: 32137
  chr8:89339042-89339983
  Hyper

SEQ ID NO: 129708 - DNA, 941 bp, Homo sapiens
  chr8:89340043-89340984
  Hyper
cacacacgcgcgcatacacacagcccgacacacacgcacgcgcgcttcttaaaggagacggctcataaaggattccccactacggtagggcgcaccggaggtatccagcccgcgacaagggccctggtttgagcacagctcttcgacagtatctcccatcccgcatccccgaggcaggcacccaggaacttgggcggctccattctttcttcccgcccaccctgccgcctcgcatctaaaaacgagtgcgcccctctccagccatgagctgggtggggctcaggctgcggaccctagtggggcctggggagcggcccaaccctggtcctggagagcggtcggcattcctgaggaagcggccctggaagaataggggcgctgggaatcagaggagcgcctggtcactgagcgcccctgggtggctcgggtcggtggccggggctgaccaagtttgggaagactgagatagcaaatcccgaacgtccaaaactttgttggggtcccgagcctgtggcctggtgtcttcctgaatcccctctaccatagctacattccgccttccaggcttgaggagtaggcacagggttttggtggcggactagacaaatacagaagcgggatgaaaacgctcactttccaagtgaacggtggacacacgcgcacagtgggacccgggagagatggtcctgggtgttaacaaaacatccgatgagagggatgggggcgctggaaagaaaccggctgcgggagccaggggaagggttggggaaagaaggagaagaagcagcctgaggaaaggcgagtaaagcagctggcaagggcgggaggaagaggctgctcgcagaccgagcgggggagaggctggcgggagctaggagagctgcaggcaagagggggaggcggctggcaagaagcacgggcgaacgcgggcagggaacttc

SEQ ID NO: 129709 - DNA, 79 bp, Homo sapiens; identical to SEQ ID NO: 99922
  chr8:89687899-89687978
  Hypo

SEQ ID NO: 129710 - DNA, 17 bp, Homo sapiens
  chr8:89830498-89830515
  Hypo
gccggaaaacatatgtc

SEQ ID NO: 129711 - DNA, 99 bp, Homo sapiens; identical to SEQ ID NO: 99925
  chr8:90768479-90768578
  Hypo

SEQ ID NO: 129712 - DNA, 39 bp, Homo sapiens; identical to SEQ ID NO: 99926
  chr8:90768818-90768857
  Hypo

SEQ ID NO: 129713 - DNA, 137 bp, Homo sapiens; identical to SEQ ID NO: 1578
  chr8:90913516-90913653
  Hypo

SEQ ID NO: 129714 - DNA, 951 bp, Homo sapiens
  chr8:91094254-91095205
  Hyper
aatccagccttctttcgcgcctgctggagctcctggatcaagttctgcagctcctttccttccaggtaaccacttcctgcaaagacaaagaggcacccaggtgtcagatatctcattccaagtgtctttcccgttcactttccaagacagttatctttctggcgacccgagaggctctctcttgcctggacgttgattaaccagcaaagtgtacagacggtgaagcgctcccctcctggggtatcaaactttagatccactgaggacaaaggaggatggttggggtgctaagcgcagccacagaaactttgggggggcagcattccccaatccctgctctctctctcctaccattaccgttcctggaaagacaaaagtttaaggttttgggattacggtggaaacaatataaactttcaggttgacagtttggcggccagtcggggagataagaagataagattaggcagaagggggaagaagtaaagaatagaaaggagggataatgggatcaggaggctcagaaaagggcaaagaatgggaaggggcatggaaacgggtcttgaaacagttaaaaagagaagataatcaccgtcagcgtcgaaatggagccagatctcgaaaaactgtgaggctgtgatgagggatgactgcaggtgggattctgccattgtacagcggggtgtgtgtctgggtgtgtgaatatgcgtgtgtctgtgtccgcgcgagggggagtgagcaaaagctcagcgtgtgcgcgagtcagggctgcggagggagacctgggcgcgggcgctgccgggcgctgtcctcggtgctgctcagctcagcgttcctccagagttctctccctacaccccgcacccagttctcagtatttatcccgacggccccaagccgggccacgcctcctccagcctcccattcctcactccccgcctcttgctctca

SEQ ID NO: 129715 - DNA, 26 bp, Homo sapiens
  chr8:91118371-91118397
  Hypo
cttattattgccaggcgcgttggctc

SEQ ID NO: 129716 - DNA, 102 bp, Homo sapiens; identical to SEQ ID NO: 99932
  chr8:91130026-91130128
  Hypo

SEQ ID NO: 129717 - DNA, 22 bp, Homo sapiens
  chr8:91163928-91163950
  Hypo
gtaatccctgcacttcggcagg

SEQ ID NO: 129718 - DNA, 187 bp, Homo sapiens; identical to SEQ ID NO: 99934
  chr8:91179163-91179350
  Hypo

SEQ ID NO: 129719 - DNA, 25 bp, Homo sapiens
  chr8:91359129-91359154
  Hypo
tgagccaccacgcctggccttcctt

SEQ ID NO: 129720 - DNA, 36 bp, Homo sapiens; identical to SEQ ID NO: 99937
  chr8:91375278-91375314
  Hypo

SEQ ID NO: 129721 - DNA, 27 bp, Homo sapiens
  chr8:91434639-91434666
  Hypo
atggatcaggccgggcgcagtggctca

SEQ ID NO: 129722 - DNA, 30 bp, Homo sapiens; identical to SEQ ID NO: 99941
  chr8:91657391-91657421
  Hyper

SEQ ID NO: 129723 - DNA, 577 bp, Homo sapiens
  chr8:91803676-91804253
  Hyper
gctgctcaggacaaacgccctgccattcgtcccttctctctgtccggacgccctcctccatccctgcacttggggccgtcgtggggctggtaggggtccccaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacgtaagtacagatggtgggagctgggcggttgcttcccagc

SEQ ID NO: 129724 - DNA, 195 bp, Homo sapiens; identical to SEQ ID NO: 41846
  chr8:91865364-91865559
  Hypo

SEQ ID NO: 129725 - DNA, 38 bp, Homo sapiens; identical to SEQ ID NO: 99945
  chr8:91887415-91887453
  Hypo

SEQ ID NO: 129726 - DNA, 1021 bp, Homo sapiens
  chr8:91996985-91998006
  Hyper
ttgaaagcctcccaccgcctggcaccaggtgctggggcagagccaaggggagctgtgtacttagctccttttttggcgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcggggggcggggcgggaggcggctccgaggggcacgaggcgggcccagggcgggcgcggggcgtggcctcgggcgctgagcctcgagagcagccgcacccctgccggggtagaaccgttaaaagggtggcgcgcgctttcccgggcgagctgggcgcgtggggttggagcggcgccacccagagccggtcgtctagggtaggaggccgcgagtgaggcgctgacaggctagccctcgacggggcgcgcccgcgtgaacggccttgggggccccagaccgtggccctgcttgtgcgaagactgggaggcgccaggcgggccgcctgctgggggcttggcggcgggttccaggcagcgtctgtgagggaggccgcctctgtgagggaggccgccgtcgtgctgacgactgagtccaccctactcctgtcccccgtcagagctgctggcaggcgctgctttccccttggtgcatttagtgggtgtcgggattcgggttggcagggag

SEQ ID NO: 129727 - DNA, 99 bp, Homo sapiens; identical to SEQ ID NO: 5080
  chr8:92083523-92083622
  Hypo

SEQ ID NO: 129728 - DNA, 30 bp, Homo sapiens; identical to SEQ ID NO: 99949
  chr8:92982980-92983010
  Hypo

SEQ ID NO: 129729 - DNA, 1194 bp, Homo sapiens
  chr8:93113946-93115140
  Hyper
tttccaagggttgaccgcccttacaaaaaataaaaaatagcacgtttcaaaaaatggatctgagcgccttgtgctgacctagccgtatttgctcaaagcaccccagtcagcgccaggtcccccccgggaaagaggtctgggtgcgccaaccaacccggtcctttcaggttcgcaaagagggcggtgagcggcgggccctggagcgcgtctccactggcccgggggcttcaccagaggggtttctggaaaacgaaaggaattatccggacgtggctccaagtctggaccccttcgggcgggagctacagggcacaaggttgtgctccccactcagaagaagcgggcaccgagtcggggccgcgacgggaacacccaggagggccggggcggctgagtccagagcgcgcagaggtcgggcggggacgactctccccatcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccacctgccaaatgcactgtgggcacctcgatcggttgttttgtcgggggagaaacccactcgtcatcttcctgctcgcataccgtgactatggagagggaagaaaaattatttttaaaagacactgtggggaatataatagtaaaaactgcatcctcggctgacccgcgaagttcagtgtcatcgcagaccggagtcacccgcgatgttcctctttgccctggtgcgtagtcctaccctaattgagcgacaagtacagcctggagcctcgcggtcgaataatccaaacgaagatgacggtcatcggaacagtaattaataacagtcaggggcccgaccccgccgcccgcccgccggccaagccctaccgcggacacttacactgcacagggccggagagtcccaccatccgccacaggctccgagctgcaaataaa

SEQ ID NO: 129730 - DNA, 535 bp, Homo sapiens; identical to SEQ ID NO: 99953
  chr8:93115382-93115917
  Hyper

SEQ ID NO: 129731 - DNA, 30 bp, Homo sapiens; identical to SEQ ID NO: 41848
  chr8:93449207-93449237
  Hypo

SEQ ID NO: 129732 - DNA, 30 bp, Homo sapiens; identical to SEQ ID NO: 99955
  chr8:93509730-93509760
  Hypo

SEQ ID NO: 129733 - DNA, 226 bp, Homo sapiens; identical to SEQ ID NO: 41849
  chr8:93848232-93848458
  Hypo

SEQ ID NO: 129734 - DNA, 69 bp, Homo sapiens; identical to SEQ ID NO: 99957
  chr8:93978166-93978235
  Hyper

SEQ ID NO: 129735 - DNA, 30 bp, Homo sapiens; identical to SEQ ID NO: 99958
  chr8:94237541-94237571
  Hypo

SEQ ID NO: 129736 - DNA, 120 bp, Homo sapiens; identical to SEQ ID NO: 99959
  chr8:94684333-94684453
  Hypo

SEQ ID NO: 129737 - DNA, 463 bp, Homo sapiens; identical to SEQ ID NO: 99960
  chr8:94712418-94712881
  Hyper

SEQ ID NO: 129738 - DNA, 300 bp, Homo sapiens; identical to SEQ ID NO: 32151
  chr8:94713129-94713429
  Hyper

SEQ ID NO: 129739 - DNA, 174 bp, Homo sapiens; identical to SEQ ID NO: 41850
  chr8:95211968-95212142
  Hypo

SEQ ID NO: 129740 - DNA, 194 bp, Homo sapiens; identical to SEQ ID NO: 99963
  chr8:95212445-95212639
  Hypo

SEQ ID NO: 129741 - DNA, 320 bp, Homo sapiens; identical to SEQ ID NO: 99964
  chr8:95246683-95247003
  Hyper

SEQ ID NO: 129742 - DNA, 77 bp, Homo sapiens; identical to SEQ ID NO: 15137
  chr8:95416054-95416131
  Hypo

SEQ ID NO: 129743 - DNA, 30 bp, Homo sapiens; identical to SEQ ID NO: 41852
  chr8:95622883-95622913
  Hypo

SEQ ID NO: 129744 - DNA, 26 bp, Homo sapiens
  chr8:95650766-95650792
  Hypo
gccaccgcgcccggcccagaaagatt

SEQ ID NO: 129745 - DNA, 183 bp, Homo sapiens; identical to SEQ ID NO: 99969
  chr8:95651327-95651510
  Hyper

SEQ ID NO: 129746 - DNA, 119 bp, Homo sapiens; identical to SEQ ID NO: 99970
  chr8:95651726-95651845
  Hyper

SEQ ID NO: 129747 - DNA, 172 bp, Homo sapiens; identical to SEQ ID NO: 99971
  chr8:95652419-95652591
  Hyper

SEQ ID NO: 129748 - DNA, 49 bp, Homo sapiens; identical to SEQ ID NO: 99972
  chr8:95652814-95652863
  Hyper

SEQ ID NO: 129749 - DNA, 109 bp, Homo sapiens; identical to SEQ ID NO: 99973
  chr8:95653342-95653451
  Hyper

SEQ ID NO: 129750 - DNA, 321 bp, Homo sapiens; identical to SEQ ID NO: 99974
  chr8:95654016-95654337
  Hyper

SEQ ID NO: 129751 - DNA, 27 bp, Homo sapiens
  chr8:95816428-95816455
  Hypo
tcaaaaaattaaatgcgggccgggcgc

SEQ ID NO: 129752 - DNA, 21 bp, Homo sapiens
  chr8:95837385-95837406
  Hypo
aaattacgtgctgggcgccgt

SEQ ID NO: 129753 - DNA, 21 bp, Homo sapiens
  chr8:95837646-95837667
  Hypo
aagactcggaaaaaaaaaaaa

SEQ ID NO: 129754 - DNA, 30 bp, Homo sapiens; identical to SEQ ID NO: 99979
  chr8:95960767-95960797
  Hyper

SEQ ID NO: 129755 - DNA, 28 bp, Homo sapiens
  chr8:96083320-96083348
  Hypo
aaagcataaggcaaccggccgggcgcgg

SEQ ID NO: 129756 - DNA, 30 bp, Homo sapiens; identical to SEQ ID NO: 99981
  chr8:96125751-96125781
  Hypo

SEQ ID NO: 129757 - DNA, 172 bp, Homo sapiens; identical to SEQ ID NO: 41856
  chr8:96208663-96208835
  Hypo

SEQ ID NO: 129758 - DNA, 141 bp, Homo sapiens; identical to SEQ ID NO: 99983
  chr8:96219910-96220051
  Hypo

SEQ ID NO: 129759 - DNA, 30 bp, Homo sapiens; identical to SEQ ID NO: 99985
  chr8:96314006-96314036
  Hypo

SEQ ID NO: 129760 - DNA, 77 bp, Homo sapiens; identical to SEQ ID NO: 99987
  chr8:96837358-96837435
  Hypo

SEQ ID NO: 129761 - DNA, 100 bp, Homo sapiens; identical to SEQ ID NO: 99988
  chr8:96849941-96850041
  Hypo

SEQ ID NO: 129762 - DNA, 98 bp, Homo sapiens; identical to SEQ ID NO: 99990
  chr8:97039387-97039485
  Hypo

SEQ ID NO: 129763 - DNA, 23 bp, Homo sapiens
  chr8:97095168-97095191
  Hypo
gctgggcgtggagggcgtggtgg

SEQ ID NO: 129764 - DNA, 38 bp, Homo sapiens; identical to SEQ ID NO: 99992
  chr8:97145516-97145554
  Hyper

SEQ ID NO: 129765 - DNA, 1191 bp, Homo sapiens
  chr8:97156964-97158155
  Hyper
ggtgggctccaggtgcgagcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccgacggcggcggccacgacccctcggcgcccgcgcccgggcccgcagcctcggccgagcccagctgctcgcgcatctctgcgaacaggttcttgcgctgggatctggtgaataccaccagcagggcccgctcctggggaggccgcaccctccggccgaagcccagactccgcaggtccgggggcggcggttgctggggtccccgcgcgcgcgcctcggcctccccggcgtccagctcgccccatgcggcccgcagctccaagcacagctgcttccagggctggtggcgcaggccctgccacacgtcgaagacttcccagccggccggcggcgccccctgcgggtccagggtccgcgcgtccagcagtaggggcgaaaggcaagggaagagctgcacgtggagcggcccggctggtggcccccagggcgctgagggcgcctggcgaaagagccgcagctccgcgcccaccagctcttctttgtctgagagcatggacacatcaaacaaatacttctgtctccggagaggagtgtgcgagagatcgtctgcgagataaaaaataattacagtcagtttcacttaagggggagatcagcccggtgctcttcggccgccccgggaggaaaagggcggggagtgggggcaggtcggccgggcagtccagcttgcccggcccagggcctgaccaccccggctccccatctggctggtgcatggcgcggggaagggggcgcgccaggacgggccccctccttcgcgtcagctccggactctcagggcggaagtcggtggctgctggcgaggcggcggcggcggcctaccgggttttccccccaaaaggcttcgtaaccactaatgtgccctttgtggtctcaagcctgggccgcgtttcccctagacctcctctgggctgggctggctcgttctcgttgacgtctcaaatgtcac

SEQ ID NO: 129766 - DNA, 511 bp, Homo sapiens; identical to SEQ ID NO: 99996
  chr8:97165624-97166135
  Hyper

SEQ ID NO: 129767 - DNA, 91 bp, Homo sapiens; identical to SEQ ID NO: 99997
  chr8:97166425-97166516
  Hyper

SEQ ID NO: 129768 - DNA, 30 bp, Homo sapiens; identical to SEQ ID NO: 99998
  chr8:97166873-97166903
  Hyper

SEQ ID NO: 129769 - DNA, 45 bp, Homo sapiens; identical to SEQ ID NO: 32159
  chr8:97167178-97167223
  Hyper

SEQ ID NO: 129770 - DNA, 4245 bp, Homo sapiens
  chr8:97169648-97173893
  Hyper
tgtacaggagcaagtcgcccatgcctcctggactgacttcggggctcctttccttttcttcgctcctccccttgggggacccccggctccaccgagccaggccagccccactcgacggcgatttaaacatcccttaggcaaggcgccaagttagcgctgctggcccagctctaggcgggccgctgctctttcctcctcgccaggccgtccacgcgttgggggaggggaccctaggggggttggcgcggttaagagccccacgtgagaggggcggaagtccttgccaggagccggggatgcgcggctggcgggtcccttccatcacgggagacgagacaccgtttgatgtgttatgacatgaaccctcaattagatcgctgagttgaaacactccaatcaggggcccgatgctaagcaagccccggaaggtccagcctgaggtcaccgccggtgacacatcaaatcaaaatcagtgagagggaaagtgaggctttccctttatcaagctggggctgcagccagcaacgcaccccctcctctgcgcacccctcccgcccgtggctccgcactccttcacccccgcgcggcgtgcgacaagccgcaccgccttcccagtcaacgaactgcctttcttcgcattttctgagaacccggagacgcggaggagacagcgcctttgaagatgctgtccgggtggtcatgcagcgtctcctcccgctgtggaccgctcgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagcttccttagcctccttccgcaattgtagtagagaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgctgacctcgggctgcagcggcgagaccctcgagcaaggaacgcgactatgagtgagaggcggggactggagccggggaagagctcggggctgggggcgggggggccgttagcctgctctaaaaagcttaagagatgtgcgagcacccagggtagcagtggctgaagcagcttccgaatcccgaaccccagcgctgcaaggtttccgggcaaccccacttaactgggagcaggtcaaagtcatggagctaagtctagggaggatggaggagtggatatctgcctaaatcgcttttatcccgtcattttcttccttccttctctttactcttcctttcctttttctcccttcctttcctgtctccttccacattattgtctctctcctttaggagcttagtttccgatgcctgtggatccttccctgatttctgggaccagaggtggtgcgaggttttcttgagggcactggccacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccagcgcagggaccaacggaaaacccgcgcggcgccaggaccagggggctgcccgacgccgctcgcggactagttcctcagactgtgggactccctagtgccggctttgcccagggctttccaaggctgtctcatgccctagatctgccccagcagctcaggccttggactgcgaacccagtatcccgagacaccgattccatcagtccccatcccgacccctctccagccgggttcatccgcctgctgcctcccgtcctccacgtttcccccaccagccaccaacaagcggcaaccacgctgccttctgcaaaagaggaagaaggaaagaagggagagagaaagaaagggggggaaaggaagggaggtttagagactggaatagaatccgcagccacattcagaaacttactcgagcttgagaaaaacaatttaagaaaagtaaaaaggaagtgtccagagcaggaagggaattcacaaatgtagcctccagcgggaacagctccctggctgccgagctccagcgggaggggagtcgagcgttttctttgccacttacctagtcccctgtctacaaagctggtgatcgtattagccgacttggaagactggaaaaagctggcattgatgcccagcttctcagcgatggagtaagtcctgtagattgacagcatgtactcgtggggcaccacgcgcggacccctgcctggcggctcctgcgcccggggctgctgagcccggggttcgtcctgaggccgcggctgtggttcctggccctcccggcccgcgtcactgtcgcgcggcgcccgctgcatcttgccttccttgcggcttcgcatgcccttggtggaacccagctcggcggacgacgaggaggatgagatggaagcctgctggaaaccgggcaaatcccacagaaaactgatgaggaagacggccgagagcaggaccctgggagtatccatggcgggcaagtggctgcgtctccccaggaggcggtggcggcggcgcaggacgcgcggggcacggagcggctggacagcggccggggcccggctcctcgggcggactcggagtgcgaggagccgggtcccagccacacaaaccccggccccgccacgccccctcccgcccctcgccgggaggggaggaatggggagggagggcagaggaggggtggggagggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggcggtggtaccctccctcctcggccccaaccgccaggcctgccgtttgcgcccctcaggggccagcccggagccagagaagcctcgccctgggccaggcgcagggcccagctcggaacagccccattttctcggttgggtatcgctctccacaaagacaggcgtctattcccgaccctcgaggtcaggcaaaggccacgagtctttagagtttggatcgatgctaaaagctgctgcgctcccctgcaggccccagcctctcctctcgcagtccccaacctcttctgacgcagactttagctgctccacttcttcgtctgctcccgggatcctctccctctcgcggcctgccccccgcctccactgcatc

SEQ ID NO: 129771 - DNA, 29 bp, Homo sapiens
  chr8:97272421-97272450
  Hypo
ctcggcccattctgcgatgattttagaaa

SEQ ID NO: 129772 - DNA, 497 bp, Homo sapiens; identical to SEQ ID NO: 100013
  chr8:97339742-97340239
  Hypo

SEQ ID NO: 129773 - DNA, 2150 bp, Homo sapiens
  chr8:97505578-97507728
  Hyper
agaaaagctacatacgtctctcgtttcttcactaattgttctctagaaaagggaaagtgaagaagggaaagagaaaagacaacggggaagaaaagagcatagaggagagaggaaaagtggggagagaaaggaagaaaaggactgagaaaacgcaggagccctggcttgccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaagcttgagcaccccagatttcgtctgcagcctcag

SEQ ID NO: 129774 - DNA, 321 bp, Homo sapiens; identical to SEQ ID NO: 100030
  chr8:97657790-97658111
  Hyper

SEQ ID NO: 129775 - DNA, 32 bp, Homo sapiens; identical to SEQ ID NO: 100032
  chr8:97819738-97819770
  Hypo

SEQ ID NO: 129776 - DNA, 163 bp, Homo sapiens; identical to SEQ ID NO: 100033
  chr8:97982654-97982817
  Hypo

SEQ ID NO: 129777 - DNA, 43 bp, Homo sapiens; identical to SEQ ID NO: 100034
  chr8:97983057-97983100
  Hypo

SEQ ID NO: 129778 - DNA, 568 bp, Homo sapiens
  chr8:98289818-98290386
  Hyper
cagtccagggggagccggcaggcggcctcctccccgagccggaggagctgcgcggacgcagcggcttccaggccaccccaccccgcgccagcctgcacctgtgccgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccatttcatctcttccgcgcgggctcatcgtgctctcagggtc

SEQ ID NO: 129779 - DNA, 30 bp, Homo sapiens; identical to SEQ ID NO: 100037
  chr8:98307773-98307803
  Hypo

SEQ ID NO: 129780 - DNA, 34 bp, Homo sapiens; identical to SEQ ID NO: 100038
  chr8:98404798-98404832
  Hypo

SEQ ID NO: 129781 - DNA, 30 bp, Homo sapiens; identical to SEQ ID NO: 15140
  chr8:98738336-98738366
  Hypo

SEQ ID NO: 129782 - DNA, 39 bp, Homo sapiens; identical to SEQ ID NO: 100041
  chr8:98748495-98748534
  Hypo

SEQ ID NO: 129783 - DNA, 28 bp, Homo sapiens
  chr8:98787775-98787803
  Hyper
aagggaagaaaatcgcaaggaactagac

SEQ ID NO: 129784 - DNA, 152 bp, Homo sapiens; identical to SEQ ID NO: 100043
  chr8:98788285-98788437
  Hyper

SEQ ID NO: 129785 - DNA, 213 bp, Homo sapiens; identical to SEQ ID NO: 100044
  chr8:98788792-98789005
  Hyper

SEQ ID NO: 129786 - DNA, 30 bp, Homo sapiens; identical to SEQ ID NO: 100045
  chr8:98881022-98881052
  Hyper

SEQ ID NO: 129787 - DNA, 67 bp, Homo sapiens; identical to SEQ ID NO: 100046
  chr8:98881817-98881884
  Hyper

SEQ ID NO: 129788 - DNA, 705 bp, Homo sapiens
  chr8:99076589-99077294
  Hyper
tgccataccctccaccgtctcccctcctgtctcctgggctctactcctccctgccctcctctgcgtcctggccctcccgctctcttccgctttgcgctcccaggctccttccacctcctgccagctcccttcctcctccaggtgcgcaccccctaccattagccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcgggtgggctaactccccaggaggtccaaagggtgtgtcccgtggccaccccgcctggcaggagccgggccttgtcccggaggatgcgagcagaacccgggacaaagcgcgatttccttccaaatctggagcggcgctgctgtgaccgcgggtgcggcggccctggtgcgctccgcggcgctcgctgcgagacgcgcggggcccgaggccgggcgctggattcaccctgtccgctgatgggatctcggggagttggtgttgaggccctaaggcggttagcctcggcattgccttaaa

SEQ ID NO: 129789 - DNA, 78 bp, Homo sapiens; identical to SEQ ID NO: 100049
  chr8:99130933-99131011
  Hypo

SEQ ID NO: 129790 - DNA, 1564 bp, Homo sapiens; identical to SEQ ID NO: 100050
  chr8:99438813-99440377
  Hyper

SEQ ID NO: 129791 - DNA, 224 bp, Homo sapiens; identical to SEQ ID NO: 100052
  chr8:99950717-99950941
  Hyper

SEQ ID NO: 129792 - DNA, 110 bp, Homo sapiens; identical to SEQ ID NO: 100053
  chr8:99951392-99951502
  Hyper

SEQ ID NO: 129793 - DNA, 1340 bp, Homo sapiens
  chr8:99951797-99953137
  Hyper
aaacaagtctggagacgggagggtagcgctgctcagctccagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactgcgatgtcatcggtaaacctggtcttccttgtcacggacactgaagcgcttggttcgaaaagcaccatgaattcgaagcagccttggacgcgggatcatgggcgttagcctggctctctccgacgaggcaaactgcaggagatccccttccctggagtcaccggaaggcgaaagcacgctctgtgcccgcgcgccgccccgggagcccgctcctaccccctcggcgtgcggcgcgggcctggagaccgcggagcccgagccgtatccagcttgtgcaggagccggtgcgcccttccgcccgctcctcccccgggaccatcctcacgctccagggtcgcggaggcatcttgcgactagcgaggggctgacggtggcctgggtggccttgcgccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggagtggggcagcctgtctgcacgcggtcccctgggaaacccctctgcatctcccgcccggacaaggtccccggccttggaatctgcgccgccccgcacgcgaccgcctgcgaactccctgcgctggggtcagaactggtatctttctcctcctctggggaagtcagggcagcccggagtggcgtcgtgggtccgaaaaatccgtctcagaaacccaccaggagaaaaggctctggggtgggggacaccatgtggggctcccacaaaggacccgacggtgggtgtggaga

SEQ ID NO: 129794 - DNA, 606 bp, Homo sapiens
  chr8:99954156-99954762
  Hyper
gcggcaggaatggaacggctccgcggagacagcctcgggggcacagccgggccactgcagactccgggacttccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggccacgcggcatcccccaaagctggagctcgccgactcttccctaccttttcaagagaccgtagtcgtgcccagaacgccggcgtggcccagactccattttggaacttcgcaggctggcgtggacgaagtaaacacatttatggaaaaaccccggggttaggaggtttgcggaaagagggagcagctcgtggggttggaaat

SEQ ID NO: 129795 - DNA, 128 bp, Homo sapiens; identical to SEQ ID NO: 100060
  chr8:99955180-99955308
  Hyper

SEQ ID NO: 129796 - DNA, 50 bp, Homo sapiens; identical to SEQ ID NO: 100061
  chr8:99955973-99956023
  Hyper

SEQ ID NO: 129797 - DNA, 423 bp, Homo sapiens; identical to SEQ ID NO: 100062
  chr8:99957286-99957709
  Hyper

SEQ ID NO: 129798 - DNA, 2169 bp, Homo sapiens
  chr8:99960048-99962217
  Hyper
tttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacaggtgaggcgggcaaggaggatggctgggagagggaaagcgaatttgtcctggacacaccgagtcctgatagacattcccagtgtcattataatcccctgtgatctaaaatacaccctcagtcacgctcctcagcccggttcagctaattcccaacatctaccctttctttcccccagcggctcttgctacgttcttgtttggaatgagggagggcctttcctcagtcttggacaggaacaatctgttggccttagtcctgggatggttatcctgtctcctcccggtgctgtggggagtggtgcaggcagaacccaggtaccctggggtgccggtcctggctgcagtcgggctacttctgttgggtttcgtccctccccccac

SEQ ID NO: 129799 - DNA, 274 bp, Homo sapiens; identical to SEQ ID NO: 100066
  chr8:99963588-99963862
  Hyper

SEQ ID NO: 129800 - DNA, 1175 bp, Homo sapiens
  chr8:99985845-99987020
  Hyper
ggcctaggcctagttcgtgtccatgaagcctctccacgtggccgacttcccttagagaagtcccacaagccctcagccctcacagcctcgcccgcgacgccgtgcccacccctcccctggcagccccgagactctgggcgtgtgcttcccgctccccgagggccttaggcccagcggacgcccggccggagcctgatgccggcggcctccccctccctcagcgaggcacgcgcgtccccaggaccgccggtgccggggcctttaaccctggccgccgacgccgcggggaaaggaagcttctgcggctacagatggcgcaggccccaggtcgcagagaagccctatccaactctgcggactggccctgggagaaagggcccgggagttgcttctccagtcggtgaacgctccgttgagccacgtctatgcgcttgctcatggataagcgcactgggggactatactgcagtgtgaccgccagtgtccccagggaggctgcggaaaagtagaggcaatgagacccgagcagaaatagggacttctcgcggcagtccgcacggaagcagctggggagcatccagctcgaccctccccacaggcccagggtcgggacaccgagggaaggcgcggcgcgcgcggcaaggccaggggcgcggggctgggctcggccggcacaagtgctcggaccgcggagcgtcctcggtgaggcgttcggtatggattgggtaggagcggccctgggcgatgggcctgacgtcggtgggcgcagttgaggccactgcaaggccgctggatcccggatccgcacccgagacggagcgggggccacacgggataaccgagggggcgaacgggagtttcgggcctccgctccctctccgggtgggggacaggtcgccgagtccgaggtcgggcgcgaaggccactcgcattttcccgccttccgcgagcaacccaggggccctgcgggaggaggagagggtcccgggagtccgcccttccctgcgccttcgggaccggcaggaggcgctgcgcgggcgaattaaaagaaaaggaaaagctcgtagtggaggtgttaccgcatcctgcctttggacgctactcttagttgagtgacccgattcggaccttaggggcgttagggtctcctccaccgcctccctcccctgttaaaa

SEQ ID NO: 129801 - DNA, 94 bp, Homo sapiens; identical to SEQ ID NO: 100070
  chr8:99987080-99987174
  Hyper

SEQ ID NO: 129802 - DNA, 154 bp, Homo sapiens; identical to SEQ ID NO: 98317
  chr8:100026613-100026767
  Hypo

SEQ ID NO: 129803 - DNA, 36 bp, Homo sapiens; identical to SEQ ID NO: 41867
  chr8:100245127-100245163
  Hypo

SEQ ID NO: 129804 - DNA, 101 bp, Homo sapiens; identical to SEQ ID NO: 98323
  chr8:100359726-100359827
  Hypo

SEQ ID NO: 129805 - DNA, 145 bp, Homo sapiens; identical to SEQ ID NO: 98324
  chr8:100519073-100519218
  Hypo

SEQ ID NO: 129806 - DNA, 103 bp, Homo sapiens; identical to SEQ ID NO: 41869
  chr8:100904181-100904284
  Hypo

SEQ ID NO: 129807 - DNA, 216 bp, Homo sapiens; identical to SEQ ID NO: 41870
  chr8:100906569-100906785
  Hypo

SEQ ID NO: 129808 - DNA, 29 bp, Homo sapiens
  chr8:100961902-100961931
  Hypo
cctaaagatttcttcgtacatagtaaact

SEQ ID NO: 129809 - DNA, 639 bp, Homo sapiens
  chr8:101118005-101118644
  Hyper
tctcatgtctgggagcggggataccgctaggagggcaggaggtaaagtccagaggctggcgcgtggtgcggccccgacgccgcgggctgatcctctgtccctgtggggccgccacctacccgcggtgagcctcttctcgggcatgccgtccccgctgcccgcgcctggagcccgcgcgggccgtcagggccctagcgcgcgggtccagcgcgggtcagggcctgagcgacgcggcgacggcgcgcgggctccggagctacgctggctagcgtggccggcgccgcgccggggttgctatggagcttagacaatacggccgcccagggaggccgaggccggccactcaggtgcctttcggggttcccaagctgcgacgggaacacccccgccgccccctaccctcccttcctcctcctctgggcagggaccagcgcggcgaacgaaggctgggggcggacgcgcgtgtggacccccagcgcggtcacccggaaggggcgccctggagacgcctgtgtccctcgagactccactggcagcgaattcgttactgtggtgaccgctgctcaggtccgttattcctccactacagcccgccagcaacggccagggaaacgcggtgctccacgggagggagaggcc

SEQ ID NO: 129810 - DNA, 150 bp, Homo sapiens; identical to SEQ ID NO: 41871
  chr8:101156747-101156897
  Hypo

SEQ ID NO: 129811 - DNA, 48 bp, Homo sapiens; identical to SEQ ID NO: 98331
  chr8:101158248-101158296
  Hyper

SEQ ID NO: 129812 - DNA, 23 bp, Homo sapiens
  chr8:101241341-101241364
  Hypo
aatgaggaagtaggccgggcgtg

SEQ ID NO: 129813 - DNA, 39 bp, Homo sapiens; identical to SEQ ID NO: 98333
  chr8:101257404-101257443
  Hypo

SEQ ID NO: 129814 - DNA, 30 bp, Homo sapiens; identical to SEQ ID NO: 41873
  chr8:101299821-101299851
  Hypo

SEQ ID NO: 129815 - DNA, 30 bp, Homo sapiens; identical to SEQ ID NO: 98335
  chr8:101300280-101300310
  Hypo

SEQ ID NO: 129816 - DNA, 30 bp, Homo sapiens; identical to SEQ ID NO: 98336
  chr8:101428824-101428854
  Hypo

SEQ ID NO: 129817 - DNA, 30 bp, Homo sapiens; identical to SEQ ID NO: 41874
  chr8:101438141-101438171
  Hypo

SEQ ID NO: 129818 - DNA, 79 bp, Homo sapiens; identical to SEQ ID NO: 32204
  chr8:101661840-101661919
  Hyper

SEQ ID NO: 129819 - DNA, 274 bp, Homo sapiens; identical to SEQ ID NO: 98339
  chr8:101693763-101694037
  Hypo

SEQ ID NO: 129820 - DNA, 30 bp, Homo sapiens; identical to SEQ ID NO: 41876
  chr8:101717092-101717122
  Hypo

SEQ ID NO: 129821 - DNA, 36 bp, Homo sapiens; identical to SEQ ID NO: 98341
  chr8:101726909-101726945
  Hypo

SEQ ID NO: 129822 - DNA, 42 bp, Homo sapiens; identical to SEQ ID NO: 41877
  chr8:101729504-101729546
  Hypo

SEQ ID NO: 129823 - DNA, 40 bp, Homo sapiens; identical to SEQ ID NO: 98343
  chr8:101736275-101736315
  Hypo

SEQ ID NO: 129824 - DNA, 27 bp, Homo sapiens
  chr8:101766351-101766378
  Hypo
cctcaagcgatccgcctcagcctctct

SEQ ID NO: 129825 - DNA, 173 bp, Homo sapiens; identical to SEQ ID NO: 32205
  chr8:101821973-101822146
  Hyper

SEQ ID NO: 129826 - DNA, 140 bp, Homo sapiens; identical to SEQ ID NO: 98346
  chr8:101872139-101872279
  Hypo

SEQ ID NO: 129827 - DNA, 68 bp, Homo sapiens; identical to SEQ ID NO: 98348
  chr8:102039492-102039560
  Hypo

SEQ ID NO: 129828 - DNA, 153 bp, Homo sapiens; identical to SEQ ID NO: 98349
  chr8:102092984-102093137
  Hyper

SEQ ID NO: 129829 - DNA, 213 bp, Homo sapiens; identical to SEQ ID NO: 41880
  chr8:102155655-102155868
  Hypo

SEQ ID NO: 129830 - DNA, 32 bp, Homo sapiens; identical to SEQ ID NO: 98355
  chr8:102504728-102504760
  Hyper

SEQ ID NO: 129831 - DNA, 554 bp, Homo sapiens
  chr8:102505540-102506094
  Hyper
gtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgcgtccttcccgtcccggacaggcactccagacgcgtcggggagccacagcctgcgcggccggagccgcccgcgggtcactgggcccggtccggccgcgtcctgacggcc

SEQ ID NO: 129832 - DNA, 38 bp, Homo sapiens; identical to SEQ ID NO: 98357
  chr8:102506405-102506443
  Hyper

SEQ ID NO: 129833 - DNA, 30 bp, Homo sapiens; identical to SEQ ID NO: 98358
  chr8:102517511-102517541
  Hypo

SEQ ID NO: 129834 - DNA, 624 bp, Homo sapiens; identical to SEQ ID NO: 98360
  chr8:103135899-103136523
  Hyper

SEQ ID NO: 129835 - DNA, 30 bp, Homo sapiens; identical to SEQ ID NO: 41881
  chr8:103403324-103403354
  Hypo

SEQ ID NO: 129836 - DNA, 90 bp, Homo sapiens; identical to SEQ ID NO: 98362
  chr8:103613211-103613301
  Hyper

SEQ ID NO: 129837 - DNA, 94 bp, Homo sapiens; identical to SEQ ID NO: 98363
  chr8:103618015-103618109
  Hypo

SEQ ID NO: 129838 - DNA, 41 bp, Homo sapiens; identical to SEQ ID NO: 41882
  chr8:103629841-103629882
  Hypo

SEQ ID NO: 129839 - DNA, 214 bp, Homo sapiens; identical to SEQ ID NO: 98365
  chr8:103768734-103768948
  Hypo

SEQ ID NO: 129840 - DNA, 985 bp, Homo sapiens
  chr8:104152711-104153696
  Hyper
gccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaagcccagggagtggggtcgaccagagccccttaccgaaggctgcgccgatgccccagcttccagcagcccaatgctctttggccttgtccaaagcttgctcgctggtcgggagaccggtgggtgggaggacagcccacctcctccgcacacatatccctcagccacccaccccctgatccgcccagggccgcctccgccccgctttggcccatctgccatcccctggccacctgcgtacccagccgggt

SEQ ID NO: 129841 - DNA, 20 bp, Homo sapiens
  chr8:104235237-104235257
  Hypo
tttaaaactttttggcgggc

SEQ ID NO: 129842 - DNA, 93 bp, Homo sapiens; identical to SEQ ID NO: 98369
  chr8:104310870-104310963
  Hyper

SEQ ID NO: 129843 - DNA, 72 bp, Homo sapiens; identical to SEQ ID NO: 98370
  chr8:104311349-104311421
  Hyper

SEQ ID NO: 129844 - DNA, 165 bp, Homo sapiens; identical to SEQ ID NO: 41884
  chr8:104382635-104382800
  Hypo

SEQ ID NO: 129845 - DNA, 23 bp, Homo sapiens
  chr8:104488605-104488628
  Hypo
actgcgcccggcccataatatat

SEQ ID NO: 129846 - DNA, 574 bp, Homo sapiens; identical to SEQ ID NO: 98374
  chr8:104510980-104511554
  Hyper

SEQ ID NO: 129847 - DNA, 1943 bp, Homo sapiens
  chr8:104511983-104513926
  Hyper
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaagtaaggacctggctccatattcccgcctctctccctgccctccgccccctcgcccactgccctgcggccgcctgcgcgccccagttcgccgccctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctcggcgagtgctaacaccc

SEQ ID NO: 129848 - DNA, 874 bp, Homo sapiens
  chr8:105235249-105236123
  Hyper
cctgtgtttgaggagcgttaaaaaaaactgtgaacctgaggaaagggaaagtgactaccagaaatttaccggtttacttatctgagatgcctaactcactgcatctaattagtcaccactccctggccttaaccacgcggagggaagaggaaacagcaggagctactcggagcagctgcccgggacctgaggcgcgcgccccggagccaccagcccaccgaggtgcagccgcgccgccacctccccctccggccgctgattggcggggaccgcagcatcagcggcatctccctgcgcggggagggcagcgagactccagcagctccagcctccaggattctcagctccctcccgggcgagacctcggacgttcactgcgagcagccgctccgcccgccaccgcctccatctcctcctctggacccctctccaataaattggaggtcccggcggccaggaaagccacgtctcctccgggctgggtcagggaggcaggggccagagcctcagggtcccgtggcaccaacctggcttctggcccactggtcccggaaccgctgcggacgctgcgccccagccgccaagacgccgcgtatcttgtaccgcgggaaaagcgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctctatctgtttagaaagtcggtggctggagggttggccggggcagagagaactccacgtagcagtgtccca

SEQ ID NO: 129849 - DNA, 227 bp, Homo sapiens; identical to SEQ ID NO: 98385
  chr8:105385866-105386093
  Hypo

SEQ ID NO: 129850 - DNA, 40 bp, Homo sapiens; identical to SEQ ID NO: 98386
  chr8:105456591-105456631
  Hypo

SEQ ID NO: 129851 - DNA, 184 bp, Homo sapiens; identical to SEQ ID NO: 98387
  chr8:105459406-105459590
  Hypo

SEQ ID NO: 129852 - DNA, 706 bp, Homo sapiens
  chr8:105478728-105479434
  Hyper
ccctctgacacccgccggggctgcgctccttcccgcccacccagctcctcggcgccgcgccgcgcgaggcggccctgctgaggaccccgggacgactggggaggctgcccgagcctccgtgggtaccgcggggcgggggcgcggcggggcgggtaccttggtgccctggtggaagtcgtcgatggaccgcgagcccatgaaggggaactgcatgtgcgtgtgtgtgtcgatgcctccgggcaggacgagcttgccggcggcgtcgaggacccgcagccccgcaggagcgcccccgggaggcagcaggtcgtgcccgagtgcccgcaccacgccgtcctccaccagcacgtcggccacctccgagaagtcatcgttgaccacgcgacccccgcggatcaggagccgcgagggcgccgccatagcgaggggcgcgcggggtcctactcggcccgggctgcgcgcaggggctgggttgggcgggccgggcgggcttggggtgccctcctgcaaggtccccaccgacagcccccgagctctgcctcaggctgcaaatccggagcccggcggcctgacgggtttatgacctggccgcatatgcggctcctccccccgggaaggctgggctggagcccaaaggccgggattgaacaggtccgcatggtccttgcacactcagaccccaagtgttctgcgccctgagttgagg

SEQ ID NO: 129853 - DNA, 120 bp, Homo sapiens; identical to SEQ ID NO: 98391
  chr8:105565464-105565584
  Hypo

SEQ ID NO: 129854 - DNA, 155 bp, Homo sapiens; identical to SEQ ID NO: 9720
  chr8:105600526-105600681
  Hyper

SEQ ID NO: 129855 - DNA, 677 bp, Homo sapiens; identical to SEQ ID NO: 98393
  chr8:105601010-105601687
  Hyper

SEQ ID NO: 129856 - DNA, 152 bp, Homo sapiens; identical to SEQ ID NO: 98394
  chr8:105601931-105602083
  Hyper

SEQ ID NO: 129857 - DNA, 120 bp, Homo sapiens; identical to SEQ ID NO: 98396
  chr8:105645375-105645495
  Hypo

SEQ ID NO: 129858 - DNA, 30 bp, Homo sapiens; identical to SEQ ID NO: 98397
  chr8:105692986-105693016
  Hypo

SEQ ID NO: 129859 - DNA, 28 bp, Homo sapiens
  chr8:105977049-105977077
  Hypo
gccatcttgtaaccgcccattttattag

SEQ ID NO: 129860 - DNA, 185 bp, Homo sapiens; identical to SEQ ID NO: 98405
  chr8:106155895-106156080
  Hypo

SEQ ID NO: 129861 - DNA, 896 bp, Homo sapiens
  chr8:106330435-106331331
  Hyper
ggccctcctccaagccgtccccacgcctcccctccaactcccacccacccctgcccccatcccccaccaccgcctggatcccccgcacttcgcccgaccaaggccggggccgtagtttgcatccggactggatttggatgcagccaatcctcctttggctgatggaatagtctcccctccccacagccccggcgcgcccctccctcgcgcgcctcgccgcctcccgccgcagaacaggagctgcgcggcccggagcggcggcggcggcgccggagtatccgtcccgcacgccggggcgaggggcgagcgagcgcgctcctcctcccgcgccctgcgcccccgcgctccccctctcctcgctgctcgctctcccgtccctccctccttctcttccttctttccgtgttatttttctcttctctttccccttttctctctccctgaccgttcgcttgtacattcccattctccccccgtcgctctcctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttggtgggattattgcccaggagcggggtgcgcgggacgggaaagcggtgggtgggtggcggggctaggggagatccgctcccggtcccctagatgt

SEQ ID NO: 129862 - DNA, 345 bp, Homo sapiens
  chr8:106331843-106332188
  Hyper
cgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctgtgagttcaaggcggtgggcgcgcaggggagtgcatggccctgagcccccgggtgcccgggggtcccgatggtgcttagaggacacggcgggtcaagagacaccttccgaaacaggcacgctcgcagagatcaagtcggtcaacttttcttggcttggggagaattcctccaatagcgttttataggcctgcgacatatcttcaac

SEQ ID NO: 129863 - DNA, 84 bp, Homo sapiens; identical to SEQ ID NO: 98410
  chr8:106433918-106434002
  Hypo

SEQ ID NO: 129864 - DNA, 27 bp, Homo sapiens
  chr8:106466086-106466113
  Hypo
aagtgatccacccgcctcagcctccca

SEQ ID NO: 129865 - DNA, 77 bp, Homo sapiens; identical to SEQ ID NO: 98412
  chr8:106475039-106475116
  Hypo

SEQ ID NO: 129866 - DNA, 30 bp, Homo sapiens; identical to SEQ ID NO: 15145
  chr8:106500552-106500582
  Hypo

SEQ ID NO: 129867 - DNA, 38 bp, Homo sapiens; identical to SEQ ID NO: 98415
  chr8:106706481-106706519
  Hypo

SEQ ID NO: 129868 - DNA, 28 bp, Homo sapiens
  chr8:106713096-106713124
  Hypo
gcgtgagccactgcgcccagccatccct

SEQ ID NO: 129869 - DNA, 986 bp, Homo sapiens; identical to SEQ ID NO: 98420
  chr8:107281909-107282895
  Hyper

SEQ ID NO: 129870 - DNA, 1124 bp, Homo sapiens
  chr8:107283112-107284236
  Hyper
agggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaag

SEQ ID NO: 129871 - DNA, 30 bp, Homo sapiens; identical to SEQ ID NO: 41892
  chr8:107359293-107359323
  Hypo

SEQ ID NO: 129872 - DNA, 185 bp, Homo sapiens; identical to SEQ ID NO: 41893
  chr8:107531614-107531799
  Hypo

SEQ ID NO: 129873 - DNA, 286 bp, Homo sapiens; identical to SEQ ID NO: 98425
  chr8:107670003-107670289
  Hyper

SEQ ID NO: 129874 - DNA, 56 bp, Homo sapiens; identical to SEQ ID NO: 98426
  chr8:107670922-107670978
  Hyper

SEQ ID NO: 129875 - DNA, 18 bp, Homo sapiens
  chr8:107789174-107789192
  Hypo
gcccggccagctgtggat

SEQ ID NO: 129876 - DNA, 164 bp, Homo sapiens; identical to SEQ ID NO: 98428
  chr8:108134662-108134826
  Hypo

SEQ ID NO: 129877 - DNA, 312 bp, Homo sapiens; identical to SEQ ID NO: 98429
  chr8:108509338-108509650
  Hyper

SEQ ID NO: 129878 - DNA, 30 bp, Homo sapiens; identical to SEQ ID NO: 98431
  chr8:108581145-108581175
  Hypo

SEQ ID NO: 129879 - DNA, 77 bp, Homo sapiens; identical to SEQ ID NO: 41895
  chr8:108582504-108582581
  Hypo

SEQ ID NO: 129880 - DNA, 17 bp, Homo sapiens
  chr8:108582641-108582658
  Hypo
ggcggagaaaatattac

SEQ ID NO: 129881 - DNA, 30 bp, Homo sapiens; identical to SEQ ID NO: 41897
  chr8:108588091-108588121
  Hypo

SEQ ID NO: 129882 - DNA, 30 bp, Homo sapiens; identical to SEQ ID NO: 98435
  chr8:108592924-108592954
  Hypo

SEQ ID NO: 129883 - DNA, 41 bp, Homo sapiens; identical to SEQ ID NO: 41898
  chr8:108593714-108593755
  Hypo

SEQ ID NO: 129884 - DNA, 30 bp, Homo sapiens; identical to SEQ ID NO: 98437
  chr8:108594004-108594034
  Hypo

SEQ ID NO: 129885 - DNA, 393 bp, Homo sapiens; identical to SEQ ID NO: 98438
  chr8:108601650-108602043
  Hypo

SEQ ID NO: 129886 - DNA, 96 bp, Homo sapiens; identical to SEQ ID NO: 98442
  chr8:108767551-108767647
  Hypo

SEQ ID NO: 129887 - DNA, 30 bp, Homo sapiens; identical to SEQ ID NO: 41900
  chr8:108957755-108957785
  Hypo

SEQ ID NO: 129888 - DNA, 2328 bp, Homo sapiens
  chr8:109093679-109096007
  Hyper
aaaagtccaaagtgccgaatgaaatagacagctctcaccaggtccctgggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctggaggcttccacccgccttctccgctacgcacaagtgatggagagggagggagcagttaaaaagccgcaagtgaatttcattgagaacagaagcctccaccggtgtggctgcttttgcaaagcaaatggagagagcgaagtggggcctgttttaaaaacaaacctctggaggcgaggactccccagaaaaccagcgcgggaattgctgcttaattcagaaagttcccatctcgtcgcagtttccagaaaaaagagatctatgttggcctttttctggaaagggaggtcctccccctcgacttggtacccctcccaagctccggaatacagacacacgcttgggtacacccacacaccacacacacactatgctaggtcaagtccgaagagatctgaggccgggtttggggcgcacgtggatggggaagataaaacaaatgagctacagggaagatggttaggaggacagagagaagaacaacgacgacaaaaaaaaaatgcatgtcagataagaaatacgtcctaaagagacaagtttagatgaggaggtggggcggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtctcgggcggcgcggcctccctaggcgcggtgctccatcccgggctcgggaagcgagccgcttggttagcacgtgggctggggaaaagtttgccgagaccggctgggagcgcctggcagctctggaattccagcggccgccgcggggttggcgacgccaggcaggagcgcggagcggcgggtgcagccactgggatgctccgtccccgcccgcgagcgcggtccccaggcaaggggtgcgcccgctcacactctctgcctccctaaccaattgtgtcgcttcctgcgctttctccacggtcacttcacagctaagatttctttctttccgagctgtagaaggcagaacgctctcgggaggacgaagtgatccgaagggatgtggcaagcgcactttccgatggagatgcagaccggctgaggcttgggatgcttctataagtaggtggtgctgtggtccaaggcatctaagtctaggctgcctcggagttcctgggtcctaaagccagaaacgtcccggtttccctgaggtcctaaagaacgttgacagccaacagcgcgcctaacttggagc

SEQ ID NO: 129889 - DNA, 148 bp, Homo sapiens; identical to SEQ ID NO: 98449
  chr8:109104980-109105128
  Hypo

SEQ ID NO: 129890 - DNA, 43 bp, Homo sapiens; identical to SEQ ID NO: 98450
  chr8:109144123-109144166
  Hypo

SEQ ID NO: 129891 - DNA, 56 bp, Homo sapiens; identical to SEQ ID NO: 98452
  chr8:109273857-109273913
  Hypo

SEQ ID NO: 129892 - DNA, 30 bp, Homo sapiens; identical to SEQ ID NO: 98454
  chr8:109311321-109311351
  Hypo

SEQ ID NO: 129893 - DNA, 489 bp, Homo sapiens
  chr8:109799414-109799903
  Hyper
aggcaaggctgatctcggggaggcgacctctggatgcgccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccgcgcgctctcccggcacggttcccggagaaagtcccccaatcaccagctacggcacttgtagcctctgcacgccgctcggctccgccgggtgggcagcgcccgccacggcgggcggggtggggcggggcggggcgctcccggagcatcccgggagttgtaggcc

SEQ ID NO: 129894 - DNA, 28 bp, Homo sapiens
  chr8:110086844-110086872
  Hypo
caacaaaagaatacgcaggtgcacagta

SEQ ID NO: 129895 - DNA, 31 bp, Homo sapiens; identical to SEQ ID NO: 41901
  chr8:110274990-110275021
  Hypo

SEQ ID NO: 129896 - DNA, 104 bp, Homo sapiens; identical to SEQ ID NO: 98461
  chr8:110406021-110406125
  Hypo

SEQ ID NO: 129897 - DNA, 224 bp, Homo sapiens; identical to SEQ ID NO: 98462
  chr8:110479232-110479456
  Hypo

SEQ ID NO: 129898 - DNA, 171 bp, Homo sapiens; identical to SEQ ID NO: 15148
  chr8:110548417-110548588
  Hypo

SEQ ID NO: 129899 - DNA, 51 bp, Homo sapiens; identical to SEQ ID NO: 98468
  chr8:110592338-110592389
  Hypo

SEQ ID NO: 129900 - DNA, 409 bp, Homo sapiens; identical to SEQ ID NO: 98469
  chr8:110703524-110703933
  Hyper

SEQ ID NO: 129901 - DNA, 116 bp, Homo sapiens; identical to SEQ ID NO: 98470
  chr8:110704189-110704305
  Hyper

SEQ ID NO: 129902 - DNA, 30 bp, Homo sapiens; identical to SEQ ID NO: 15149
  chr8:110961977-110962007
  Hypo

SEQ ID NO: 129903 - DNA, 1010 bp, Homo sapiens
  chr8:110986212-110987222
  Hyper
ctgcaggaaggagagcgcgcacagctgctccatgacatgcaggcggccggtgcggtagtagtgcaggacatatcggaacgcctgcgagctgcggtcgaagaagtactcgttgtccacggggttggcatcgtcgcaaagctccagagggctgggcacggcggccagggccccggggcggcggtaggaagccaccaccacggccagcttgccaaggcgcgtgtgcgggaagcaggacagcgcctgctgcgagagcacgaagcggctgccgcccacgttgaccgtgaagcagtccccgagcgccaagggctccccttcaccctcgctgcagaagacactagagtccagggaggtcagggagccgctgtccagcggcgagtccagcagcgctctgccgctggaaggcatctctaacccagtcgccgcggcctgagggcgccacaaagttggggacacgccggaagctttggtcccgcgagggcggtggcacggcccctggtggcggccgggattccccgggctcccgaaggggttacctctccttggcgcaccctctccacccgctgtgcgccttcctcctcctgccgctagggagccgggagtgcgcggaagcagcgcacaagtggcagaaagaggagacagggagcagaggaagggtcgcgctaagagagaggatcaggtgaggtccaagcccgacacagtccctgtgcacactgccggtcgccctggcccttcccaaacgttgtcaccccgcctcccaacttcgcaattgcgattcccagcccaggaggtgtacagattgaatgactcgctacttggtgggtggaggggttggggaagggaggaaggagggagatgtggggcggaggaggaggaagaggagagaagatgactcttagctgaacgcaagcaagcaagcaagcaagggggatggcgagactcactcctgcccgcaggagaccaaaacaaaaagttcagaaagcaaaggaagtggtaaccgggtcccttccaac

SEQ ID NO: 129904 - DNA, 275 bp, Homo sapiens; identical to SEQ ID NO: 98476
  chr8:110987681-110987956
  Hyper

SEQ ID NO: 129905 - DNA, 29 bp, Homo sapiens
  chr8:111003707-111003736
  Hypo
gagtgcagtggctcacgcctctaatccca

SEQ ID NO: 129906 - DNA, 18 bp, Homo sapiens
  chr8:111194106-111194124
  Hypo
gcccggccagggtttttt

SEQ ID NO: 129907 - DNA, 30 bp, Homo sapiens; identical to SEQ ID NO: 41905
  chr8:111586661-111586691
  Hypo

SEQ ID NO: 129908 - DNA, 244 bp, Homo sapiens; identical to SEQ ID NO: 98480
  chr8:111747443-111747687
  Hypo

SEQ ID NO: 129909 - DNA, 28 bp, Homo sapiens
  chr8:112347537-112347565
  Hypo
ctgatgtgttcctcacgacgtccagctg

SEQ ID NO: 129910 - DNA, 67 bp, Homo sapiens; identical to SEQ ID NO: 98486
  chr8:112636560-112636627
  Hypo

SEQ ID NO: 129911 - DNA, 16 bp, Homo sapiens
  chr8:113095708-113095724
  Hypo
acgctgtcacctctca

SEQ ID NO: 129912 - DNA, 150 bp, Homo sapiens; identical to SEQ ID NO: 98489
  chr8:113146123-113146273
  Hypo

SEQ ID NO: 129913 - DNA, 203 bp, Homo sapiens; identical to SEQ ID NO: 98490
  chr8:113175066-113175269
  Hypo

SEQ ID NO: 129914 - DNA, 30 bp, Homo sapiens; identical to SEQ ID NO: 98491
  chr8:113221643-113221673
  Hypo

SEQ ID NO: 129915 - DNA, 162 bp, Homo sapiens
  chr8:114444379-114444541
  Hyper
ccaaccagatgattccggaaagtacggtgctgcaaaaggacatttcagagcgctttcaacaagctaactgtccagtgaagttcagctccgaattctggtaaccgttcaagccctgtcagtccggtaaattgggttaacttagcaactcggtggtgcaaagcc

SEQ ID NO: 129916 - DNA, 447 bp, Homo sapiens; identical to SEQ ID NO: 98501
  chr8:114444784-114445231
  Hyper

SEQ ID NO: 129917 - DNA, 500 bp, Homo sapiens; identical to SEQ ID NO: 32247
  chr8:114445521-114446021
  Hyper

SEQ ID NO: 129918 - DNA, 517 bp, Homo sapiens
  chr8:114446931-114447448
  Hyper
tctccaaagctaaaccgattatatcagtccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtcgagccagcgacaaagaaaccttgtaagcaacctgagccgtgctttgtacatttggcagtgtagttgtgccacttaggacaagcttttcggctcagagctgct

SEQ ID NO: 129919 - DNA, 63 bp, Homo sapiens; identical to SEQ ID NO: 98505
  chr8:114447789-114447852
  Hyper

SEQ ID NO: 129920 - DNA, 849 bp, Homo sapiens; identical to SEQ ID NO: 98506
  chr8:114448753-114449602
  Hyper

SEQ ID NO: 129921 - DNA, 29 bp, Homo sapiens
  chr8:115020800-115020829
  Hypo
gcacccggcggggctcggtggctcacgcc

SEQ ID NO: 129922 - DNA, 20 bp, Homo sapiens
  chr8:115089750-115089770
  Hypo
tgagtgaatgccagccgggt

SEQ ID NO: 129923 - DNA, 37 bp, Homo sapiens; identical to SEQ ID NO: 98528
  chr8:115649501-115649538
  Hypo

SEQ ID NO: 129924 - DNA, 28 bp, Homo sapiens
  chr8:116354110-116354138
  Hypo
tttttttttttgagacggagtcttgctc

SEQ ID NO: 129925 - DNA, 528 bp, Homo sapiens
  chr8:116660295-116660823
  Hyper
aagaggaaatcagagcgtcaaatcaaggaggggtggcagcaaagaggaagcaaaagagaagacaagaggaaagagagtttatggagagaggaagccaatttgggaagtggggagaagggcaggctggccaggggatgcgacgcgacagggcagagggagtgggaagaagcgggcaggaggcggcctccacgcagctggcagggcaggcagcgctggagagggaggaggagagggaggctgcaggcaccgcgcagcagccgaggatgagagaggtaaccggagggaacgggcgcacacaactgcttccgcaggacttcctgcgataacacgcccacagcccgggcgccgagcacgcgtggtggcggccgcaggcccggggctcctgcgagagcgaacgccagcgacacacacgcagctcctgttgtgtcgccgctgccgcctaggcagggccgcagacagcagcctccttcccagactgagccaactcactctcaccgtagctgctccagaatccgtgaaaagaaaatg

SEQ ID NO: 129926 - DNA, 170 bp, Homo sapiens; identical to SEQ ID NO: 41911
  chr8:116710279-116710449
  Hypo

SEQ ID NO: 129927 - DNA, 30 bp, Homo sapiens; identical to SEQ ID NO: 98535
  chr8:116991751-116991781
  Hypo

SEQ ID NO: 129928 - DNA, 153 bp, Homo sapiens; identical to SEQ ID NO: 98538
  chr8:117065205-117065358
  Hypo

SEQ ID NO: 129929 - DNA, 30 bp, Homo sapiens; identical to SEQ ID NO: 98541
  chr8:117572696-117572726
  Hypo

SEQ ID NO: 129930 - DNA, 18 bp, Homo sapiens
  chr8:117621492-117621510
  Hypo
gagcgagactccatctca

SEQ ID NO: 129931 - DNA, 147 bp, Homo sapiens; identical to SEQ ID NO: 98544
  chr8:117824014-117824161
  Hypo

SEQ ID NO: 129932 - DNA, 639 bp, Homo sapiens; identical to SEQ ID NO: 32256
  chr8:117950319-117950958
  Hyper

SEQ ID NO: 129933 - DNA, 23 bp, Homo sapiens
  chr8:118453896-118453919
  Hypo
agccaccgcgcctggccacgcaa

SEQ ID NO: 129934 - DNA, 30 bp, Homo sapiens; identical to SEQ ID NO: 98548
  chr8:119057219-119057249
  Hypo

SEQ ID NO: 129935 - DNA, 37 bp, Homo sapiens; identical to SEQ ID NO: 98549
  chr8:119571068-119571105
  Hypo

SEQ ID NO: 129936 - DNA, 63 bp, Homo sapiens; identical to SEQ ID NO: 98550
  chr8:119964391-119964454
  Hyper

SEQ ID NO: 129937 - DNA, 45 bp, Homo sapiens; identical to SEQ ID NO: 98552
  chr8:120220486-120220531
  Hyper

SEQ ID NO: 129938 - DNA, 45 bp, Homo sapiens; identical to SEQ ID NO: 98554
  chr8:120319364-120319409
  Hypo

SEQ ID NO: 129939 - DNA, 231 bp, Homo sapiens; identical to SEQ ID NO: 98556
  chr8:120428491-120428722
  Hyper

SEQ ID NO: 129940 - DNA, 54 bp, Homo sapiens; identical to SEQ ID NO: 98557
  chr8:120429002-120429056
  Hyper

SEQ ID NO: 129941 - DNA, 30 bp, Homo sapiens; identical to SEQ ID NO: 98558
  chr8:120429286-120429316
  Hyper

SEQ ID NO: 129942 - DNA, 30 bp, Homo sapiens; identical to SEQ ID NO: 98560
  chr8:120525191-120525221
  Hypo

SEQ ID NO: 129943 - DNA, 30 bp, Homo sapiens; identical to SEQ ID NO: 98561
  chr8:120591921-120591951
  Hypo

SEQ ID NO: 129944 - DNA, 16 bp, Homo sapiens
  chr8:120695441-120695457
  Hypo
gcgcccagcctttata

SEQ ID NO: 129945 - DNA, 31 bp, Homo sapiens; identical to SEQ ID NO: 98563
  chr8:120844095-120844126
  Hypo

SEQ ID NO: 129946 - DNA, 39 bp, Homo sapiens; identical to SEQ ID NO: 98564
  chr8:120845542-120845581
  Hypo

SEQ ID NO: 129947 - DNA, 19 bp, Homo sapiens
  chr8:121002670-121002689
  Hypo
caggcgtgagccaccatgc

SEQ ID NO: 129948 - DNA, 23 bp, Homo sapiens
  chr8:121135619-121135642
  Hypo
accgcgcccggccaattttctgt

SEQ ID NO: 129949 - DNA, 89 bp, Homo sapiens; identical to SEQ ID NO: 98568
  chr8:121135998-121136087
  Hyper

SEQ ID NO: 129950 - DNA, 956 bp, Homo sapiens; identical to SEQ ID NO: 98569
  chr8:121136826-121137782
  Hyper

SEQ ID NO: 129951 - DNA, 28 bp, Homo sapiens
  chr8:121206406-121206434
  Hypo
agccattcctattcggccatcttggctg

SEQ ID NO: 129952 - DNA, 30 bp, Homo sapiens; identical to SEQ ID NO: 98571
  chr8:121289793-121289823
  Hypo

SEQ ID NO: 129953 - DNA, 30 bp, Homo sapiens; identical to SEQ ID NO: 41916
  chr8:121354745-121354775
  Hypo

SEQ ID NO: 129954 - DNA, 32 bp, Homo sapiens; identical to SEQ ID NO: 98573
  chr8:121479576-121479608
  Hypo

SEQ ID NO: 129955 - DNA, 138 bp, Homo sapiens; identical to SEQ ID NO: 98574
  chr8:121545084-121545222
  Hypo

SEQ ID NO: 129956 - DNA, 30 bp, Homo sapiens; identical to SEQ ID NO: 41917
  chr8:121566445-121566475
  Hypo

SEQ ID NO: 129957 - DNA, 30 bp, Homo sapiens; identical to SEQ ID NO: 41918
  chr8:121573169-121573199
  Hypo

SEQ ID NO: 129958 - DNA, 97 bp, Homo sapiens; identical to SEQ ID NO: 98577
  chr8:121629842-121629939
  Hypo

SEQ ID NO: 129959 - DNA, 108 bp, Homo sapiens; identical to SEQ ID NO: 98578
  chr8:121643554-121643662
  Hypo

SEQ ID NO: 129960 - DNA, 54 bp, Homo sapiens; identical to SEQ ID NO: 98579
  chr8:121705929-121705983
  Hypo

SEQ ID NO: 129961 - DNA, 75 bp, Homo sapiens; identical to SEQ ID NO: 41919
  chr8:121712263-121712338
  Hypo

SEQ ID NO: 129962 - DNA, 205 bp, Homo sapiens; identical to SEQ ID NO: 98581
  chr8:121717222-121717427
  Hypo

SEQ ID NO: 129963 - DNA, 183 bp, Homo sapiens; identical to SEQ ID NO: 41920
  chr8:121732132-121732315
  Hypo

SEQ ID NO: 129964 - DNA, 29 bp, Homo sapiens
  chr8:121823901-121823930
  Hyper
ccgatgccgttgtacgccgcagcgccctc

SEQ ID NO: 129965 - DNA, 278 bp, Homo sapiens
  chr8:121824203-121824481
  Hyper
ggcacgcgggactccgctccgggagttcgcagacgcactcggcgggagttggcagctgcactcaggctggttccccctcgcctgatcctgaccggggtggagcaacctaaaagaagaaggagagaccgagacaggggaggggaaaaaagccagcagccagttgcaaaaccccaaagcaaggggagccgcggagcagctcagcgctggagagagtccgtgggaggaggcacgctggcggtgaagggcggggacccacaacccagcggccgctcacctgt

SEQ ID NO: 129966 - DNA, 233 bp, Homo sapiens; identical to SEQ ID NO: 98583
  chr8:121825604-121825837
  Hypo

SEQ ID NO: 129967 - DNA, 25 bp, Homo sapiens
  chr8:121855050-121855075
  Hypo
cgcacccggccggaaaacatatttt

SEQ ID NO: 129968 - DNA, 144 bp, Homo sapiens; identical to SEQ ID NO: 41922
  chr8:121982491-121982635
  Hypo

SEQ ID NO: 129969 - DNA, 30 bp, Homo sapiens; identical to SEQ ID NO: 98587
  chr8:122402000-122402030
  Hypo

SEQ ID NO: 129970 - DNA, 799 bp, Homo sapiens; identical to SEQ ID NO: 98588
  chr8:122651726-122652525
  Hyper

SEQ ID NO: 129971 - DNA, 30 bp, Homo sapiens; identical to SEQ ID NO: 98589
  chr8:122653102-122653132
  Hyper

SEQ ID NO: 129972 - DNA, 106 bp, Homo sapiens; identical to SEQ ID NO: 98590
  chr8:122654322-122654428
  Hyper

SEQ ID NO: 129973 - DNA, 258 bp, Homo sapiens; identical to SEQ ID NO: 98591
  chr8:123695489-123695747
  Hypo

SEQ ID NO: 129974 - DNA, 347 bp, Homo sapiens; identical to SEQ ID NO: 41924
  chr8:123966045-123966392
  Hypo

SEQ ID NO: 129975 - DNA, 26 bp, Homo sapiens
  chr8:124001542-124001568
  Hypo
ttggataacaagtcccgtggctgggc

SEQ ID NO: 129976 - DNA, 105 bp, Homo sapiens; identical to SEQ ID NO: 41925
  chr8:124055130-124055235
  Hypo

SEQ ID NO: 129977 - DNA, 45 bp, Homo sapiens; identical to SEQ ID NO: 41926
  chr8:124055535-124055580
  Hypo

SEQ ID NO: 129978 - DNA, 142 bp, Homo sapiens; identical to SEQ ID NO: 98597
  chr8:124168256-124168398
  Hypo

SEQ ID NO: 129979 - DNA, 30 bp, Homo sapiens; identical to SEQ ID NO: 98598
  chr8:124169134-124169164
  Hyper

SEQ ID NO: 129980 - DNA, 656 bp, Homo sapiens; identical to SEQ ID NO: 98599
  chr8:124172796-124173452
  Hyper

SEQ ID NO: 129981 - DNA, 33 bp, Homo sapiens; identical to SEQ ID NO: 98600
  chr8:124185498-124185531
  Hypo

SEQ ID NO: 129982 - DNA, 16 bp, Homo sapiens
  chr8:124193486-124193502
  Hypo
gcgccacactttaaaa

SEQ ID NO: 129983 - DNA, 28 bp, Homo sapiens
  chr8:124248750-124248778
  Hypo
gggtgcagtggctcacgcctataatccc

SEQ ID NO: 129984 - DNA, 30 bp, Homo sapiens; identical to SEQ ID NO: 98603
  chr8:124255278-124255308
  Hypo

SEQ ID NO: 129985 - DNA, 17 bp, Homo sapiens
  chr8:124288888-124288905
  Hypo
gccgatgactaggtttt

SEQ ID NO: 129986 - DNA, 41 bp, Homo sapiens; identical to SEQ ID NO: 98605
  chr8:124374923-124374964
  Hypo

SEQ ID NO: 129987 - DNA, 20 bp, Homo sapiens
  chr8:124428122-124428142
  Hypo
gcacccggccctaaacacta

SEQ ID NO: 129988 - DNA, 211 bp, Homo sapiens; identical to SEQ ID NO: 98607
  chr8:124632114-124632325
  Hypo

SEQ ID NO: 129989 - DNA, 43 bp, Homo sapiens; identical to SEQ ID NO: 98609
  chr8:124934797-124934840
  Hyper

SEQ ID NO: 129990 - DNA, 209 bp, Homo sapiens; identical to SEQ ID NO: 98612
  chr8:125184265-125184474
  Hypo

SEQ ID NO: 129991 - DNA, 36 bp, Homo sapiens; identical to SEQ ID NO: 41930
  chr8:125452639-125452675
  Hypo

SEQ ID NO: 129992 - DNA, 97 bp, Homo sapiens; identical to SEQ ID NO: 41929
  chr8:125452302-125452399
  Hypo

SEQ ID NO: 129993 - DNA, 30 bp, Homo sapiens; identical to SEQ ID NO: 41931
  chr8:125568984-125569014
  Hypo

SEQ ID NO: 129994 - DNA, 30 bp, Homo sapiens; identical to SEQ ID NO: 98616
  chr8:125574006-125574036
  Hypo

SEQ ID NO: 129995 - DNA, 30 bp, Homo sapiens; identical to SEQ ID NO: 98617
  chr8:125576743-125576773
  Hyper

SEQ ID NO: 129996 - DNA, 51 bp, Homo sapiens; identical to SEQ ID NO: 98618
  chr8:125580647-125580698
  Hypo

SEQ ID NO: 129997 - DNA, 30 bp, Homo sapiens; identical to SEQ ID NO: 98619
  chr8:125618670-125618700
  Hypo

SEQ ID NO: 129998 - DNA, 135 bp, Homo sapiens; identical to SEQ ID NO: 98620
  chr8:125672489-125672624
  Hyper

SEQ ID NO: 129999 - DNA, 229 bp, Homo sapiens; identical to SEQ ID NO: 98621
  chr8:125680483-125680712
  Hypo

SEQ ID NO: 130000 - DNA, 36 bp, Homo sapiens; identical to SEQ ID NO: 98622
  chr8:125682702-125682738
  Hypo

SEQ ID NO: 130001 - DNA, 24 bp, Homo sapiens
  chr8:125739302-125739326
  Hyper
cagggtgttgttccccgcccccac

SEQ ID NO: 130002 - DNA, 30 bp, Homo sapiens; identical to SEQ ID NO: 98624
  chr8:125740333-125740363
  Hyper

SEQ ID NO: 130003 - DNA, 161 bp, Homo sapiens; identical to SEQ ID NO: 98625
  chr8:126044592-126044753
  Hypo

SEQ ID NO: 130004 - DNA, 30 bp, Homo sapiens; identical to SEQ ID NO: 98626
  chr8:126079019-126079049
  Hypo

SEQ ID NO: 130005 - DNA, 30 bp, Homo sapiens; identical to SEQ ID NO: 98627
  chr8:126156768-126156798
  Hypo

SEQ ID NO: 130006 - DNA, 121 bp, Homo sapiens; identical to SEQ ID NO: 41932
  chr8:126267003-126267124
  Hypo

SEQ ID NO: 130007 - DNA, 61 bp, Homo sapiens; identical to SEQ ID NO: 98629
  chr8:126284144-126284205
  Hypo

SEQ ID NO: 130008 - DNA, 140 bp, Homo sapiens; identical to SEQ ID NO: 98630
  chr8:126400836-126400976
  Hyper

SEQ ID NO: 130009 - DNA, 27 bp, Homo sapiens
  chr8:127089268-127089295
  Hypo
atcctgggcccggcacggtggctcaca

SEQ ID NO: 130010 - DNA, 99 bp, Homo sapiens; identical to SEQ ID NO: 98634
  chr8:127305215-127305314
  Hypo

SEQ ID NO: 130011 - DNA, 233 bp, Homo sapiens; identical to SEQ ID NO: 98635
  chr8:127518583-127518816
  Hypo

SEQ ID NO: 130012 - DNA, 80 bp, Homo sapiens; identical to SEQ ID NO: 41935
  chr8:128745542-128745622
  Hypo

SEQ ID NO: 130013 - DNA, 41 bp, Homo sapiens; identical to SEQ ID NO: 98647
  chr8:128861840-128861881
  Hypo

SEQ ID NO: 130014 - DNA, 39 bp, Homo sapiens; identical to SEQ ID NO: 41936
  chr8:128864120-128864159
  Hypo

SEQ ID NO: 130015 - DNA, 176 bp, Homo sapiens; identical to SEQ ID NO: 98649
  chr8:128872283-128872459
  Hypo

SEQ ID NO: 130016 - DNA, 162 bp, Homo sapiens; identical to SEQ ID NO: 98650
  chr8:128882652-128882814
  Hypo

SEQ ID NO: 130017 - DNA, 488 bp, Homo sapiens; identical to SEQ ID NO: 98651
  chr8:128888909-128889397
  Hypo

SEQ ID NO: 130018 - DNA, 30 bp, Homo sapiens; identical to SEQ ID NO: 41939
  chr8:128931231-128931261
  Hypo

SEQ ID NO: 130019 - DNA, 35 bp, Homo sapiens; identical to SEQ ID NO: 41940
  chr8:128962506-128962541
  Hypo

SEQ ID NO: 130020 - DNA, 209 bp, Homo sapiens; identical to SEQ ID NO: 98655
  chr8:129069803-129070012
  Hypo

SEQ ID NO: 130021 - DNA, 91 bp, Homo sapiens; identical to SEQ ID NO: 98656
  chr8:129355798-129355889
  Hypo

SEQ ID NO: 130022 - DNA, 30 bp, Homo sapiens; identical to SEQ ID NO: 41942
  chr8:130080387-130080417
  Hypo

SEQ ID NO: 130023 - DNA, 186 bp, Homo sapiens; identical to SEQ ID NO: 98666
  chr8:130116277-130116463
  Hypo

SEQ ID NO: 130024 - DNA, 203 bp, Homo sapiens; identical to SEQ ID NO: 41944
  chr8:130288699-130288902
  Hypo

SEQ ID NO: 130025 - DNA, 30 bp, Homo sapiens; identical to SEQ ID NO: 98669
  chr8:130305961-130305991
  Hypo

SEQ ID NO: 130026 - DNA, 209 bp, Homo sapiens; identical to SEQ ID NO: 41945
  chr8:130368840-130369049
  Hypo

SEQ ID NO: 130027 - DNA, 89 bp, Homo sapiens; identical to SEQ ID NO: 41946
  chr8:130369289-130369378
  Hypo

SEQ ID NO: 130028 - DNA, 30 bp, Homo sapiens; identical to SEQ ID NO: 98673
  chr8:130381962-130381992
  Hypo

SEQ ID NO: 130029 - DNA, 35 bp, Homo sapiens; identical to SEQ ID NO: 98674
  chr8:130461171-130461206
  Hypo

SEQ ID NO: 130030 - DNA, 201 bp, Homo sapiens; identical to SEQ ID NO: 41948
  chr8:130583277-130583478
  Hypo

SEQ ID NO: 130031 - DNA, 30 bp, Homo sapiens; identical to SEQ ID NO: 98680
  chr8:131046198-131046228
  Hypo

SEQ ID NO: 130032 - DNA, 30 bp, Homo sapiens; identical to SEQ ID NO: 98681
  chr8:131278061-131278091
  Hypo

SEQ ID NO: 130033 - DNA, 1028 bp, Homo sapiens; identical to SEQ ID NO: 98683
  chr8:131455184-131456212
  Hyper

SEQ ID NO: 130034 - DNA, 18 bp, Homo sapiens
  chr8:131922190-131922208
  Hypo
tttttttttttgagacgg

SEQ ID NO: 130035 - DNA, 2895 bp, Homo sapiens
  chr8:132051903-132054798
  Hyper
tcactacctcaatgccggtgaagaagcccagcaggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccagcgagtagaggggcagcgccgagtcgcctgacagctgcggcgcgtggtggttggggccgccgcccgcagggtccgaggctttgcccgagcctccactcccgctgccgctgcctccccggtgcccgtgaatgaagcgctgctccgtgatgtgtcgcaccgccgtctgccacagcagccgctgcggccgggaggcgctcctgccgtcgccggccgggggcgtcgggtggatggtgtagagttcctcgctgcctgtaaggcagcgcacatcggagagctccatggctctgggccgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctctccaagagacgcctaagcgcctgggcgccgtgcttctgctgcgcgtcgggcgggtcctggctgctgcactgggctttggacgcccactgctccgcggctgcagggggcctggccggcggtgaccggcggcagcgatgggtgcgaagttagcagatgtggctggaatcatcgcccttcggagaactccattgcgccgggatggggagcaggggcggagctgggggcgggggcaaagaaggaggaggagggggtcacggtgaggtggcggggcgccccgcgacagggttggagaggtggtagcctcggcgctaacaattcaccaaatagttaatttggaggaaggggtatgctgaggctccctcctaggctctttcctagttcgggagcaaggactgacagcgcagcgctggctctggccagaagcatccctcccggagggggtgtggggactctcgctccagggtcccagcctgagctataagacgaggtcaacgctttcagctgtgctttcgaagggtcgcagcacacagttctcatcccctttatttcgttctttggagtccatttggctcggagctaggaggatcaggagaggcgggggaaggaaaaagtggtgagggctccaaagccaagagctccgagaacgaagagaagccgccggtgcggatatctgaggctgagaaccgaagcttggcggatgaggcgaaggtttggaggagaagggaggcccgaggccgcgtggaagtcgacagagacgcctctggatctagggaagcgccgccgcgtgccaccctggagctctgaaacgcaccgcgggcgccaggcgactgggagaaatttggagacctgtcagagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaacgcggccgccgcagtcccgcagccggatgcaggtggaggagcggtggtggtcaccacctcctccaccaagactgcggctgcagccagtggagcccgggcccagagcacagtcagctgatggccaatgacgtcaggccctgggcgcgttcgcggctccccgtggcgtcccatgaaagcccaaatgaccgccttgccttgccgccccctcagtccc

SEQ ID NO: 130036 - DNA, 30 bp, Homo sapiens; identical to SEQ ID NO: 41950
  chr8:132284091-132284121
  Hypo

SEQ ID NO: 130037 - DNA, 192 bp, Homo sapiens; identical to SEQ ID NO: 98690
  chr8:132480519-132480711
  Hypo

SEQ ID NO: 130038 - DNA, 30 bp, Homo sapiens; identical to SEQ ID NO: 41951
  chr8:132783128-132783158
  Hypo

SEQ ID NO: 130039 - DNA, 212 bp, Homo sapiens; identical to SEQ ID NO: 98695
  chr8:132823274-132823486
  Hypo

SEQ ID NO: 130040 - DNA, 50 bp, Homo sapiens; identical to SEQ ID NO: 98696
  chr8:133062815-133062865
  Hypo

SEQ ID NO: 130041 - DNA, 199 bp, Homo sapiens; identical to SEQ ID NO: 98699
  chr8:133337370-133337569
  Hypo

SEQ ID NO: 130042 - DNA, 30 bp, Homo sapiens; identical to SEQ ID NO: 98700
  chr8:133412585-133412615
  Hypo

SEQ ID NO: 130043 - DNA, 925 bp, Homo sapiens
  chr8:133492260-133493185
  Hyper
gacgggctggtctccccttcagcgggaaagcatccatgggtcttaaagccccagagacttctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctccacgtcgccgggcgccagccccactttccgctcctcgtcgccggccgccgccgcgtcccctccggctgggttagccgccccgccgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgccatgatccgcgcgcccctccccacccccccccaaaagcaggcaaaggcgggccccctggggggcaggggaggccaggcagggggtcagggggtcacatcccgcgcgggtcagccgcaggaccccgagggtcgcgggccgggggctgcggagaagctgggagggcgcgcgaggctggcgcggaggcgctagggcgcgcggcggcgggagcctggaaccggcgctccggggcggcggcggcggcggcggcacccaggccggcgagcccaagacagcatcgcagtttatttaca

SEQ ID NO: 130044 - DNA, 276 bp, Homo sapiens
  chr8:133493495-133493771
  Hyper
tgcaaccaggcagtgcgccaggcggctgcagagcccggctcctggagctcccgtgggcgttggggcttcccctggatggggcgtgacggcgggcagttgggggaagaagaggaagggaggagggactggggggttgtcgcccaccaaacattggctctgtggttgcagctttgtgaatttccctcaccccctacccctgctcctcggcttcagaggtaaaagccaagttgtcgggttggtcaaggccgggcgcaccgcgaacgcacctgctctgtg

SEQ ID NO: 130045 - DNA, 92 bp, Homo sapiens; identical to SEQ ID NO: 98704
  chr8:133686745-133686837
  Hypo

SEQ ID NO: 130046 - DNA, 31 bp, Homo sapiens; identical to SEQ ID NO: 98705
  chr8:133687137-133687168
  Hypo

SEQ ID NO: 130047 - DNA, 30 bp, Homo sapiens; identical to SEQ ID NO: 98706
  chr8:133728335-133728365
  Hypo

SEQ ID NO: 130048 - DNA, 132 bp, Homo sapiens; identical to SEQ ID NO: 15163
  chr8:133811037-133811169
  Hypo

SEQ ID NO: 130049 - DNA, 30 bp, Homo sapiens; identical to SEQ ID NO: 98709
  chr8:134018690-134018720
  Hypo

SEQ ID NO: 130050 - DNA, 30 bp, Homo sapiens; identical to SEQ ID NO: 98710
  chr8:134215121-134215151
  Hypo

SEQ ID NO: 130051 - DNA, 30 bp, Homo sapiens; identical to SEQ ID NO: 98713
  chr8:134262730-134262760
  Hypo

SEQ ID NO: 130052 - DNA, 179 bp, Homo sapiens; identical to SEQ ID NO: 41955
  chr8:134470121-134470300
  Hypo

SEQ ID NO: 130053 - DNA, 110 bp, Homo sapiens; identical to SEQ ID NO: 98715
  chr8:134471909-134472019
  Hypo

SEQ ID NO: 130054 - DNA, 67 bp, Homo sapiens; identical to SEQ ID NO: 98716
  chr8:134519862-134519929
  Hypo

SEQ ID NO: 130055 - DNA, 59 bp, Homo sapiens; identical to SEQ ID NO: 98717
  chr8:134521601-134521660
  Hypo

SEQ ID NO: 130056 - DNA, 30 bp, Homo sapiens; identical to SEQ ID NO: 98718
  chr8:134525332-134525362
  Hypo

SEQ ID NO: 130057 - DNA, 63 bp, Homo sapiens; identical to SEQ ID NO: 98719
  chr8:134541589-134541652
  Hypo

SEQ ID NO: 130058 - DNA, 250 bp, Homo sapiens; identical to SEQ ID NO: 98720
  chr8:134545088-134545338
  Hypo

SEQ ID NO: 130059 - DNA, 30 bp, Homo sapiens; identical to SEQ ID NO: 98721
  chr8:134566350-134566380
  Hypo

SEQ ID NO: 130060 - DNA, 30 bp, Homo sapiens; identical to SEQ ID NO: 98722
  chr8:134566647-134566677
  Hypo

SEQ ID NO: 130061 - DNA, 50 bp, Homo sapiens; identical to SEQ ID NO: 98723
  chr8:134581243-134581293
  Hyper

SEQ ID NO: 130062 - DNA, 120 bp, Homo sapiens; identical to SEQ ID NO: 98724
  chr8:134583173-134583293
  Hyper

SEQ ID NO: 130063 - DNA, 66 bp, Homo sapiens; identical to SEQ ID NO: 98725
  chr8:134585014-134585080
  Hyper

SEQ ID NO: 130064 - DNA, 21 bp, Homo sapiens
  chr8:134724787-134724808
  Hypo
ccaccgcgcccgtcctctgaa

SEQ ID NO: 130065 - DNA, 34 bp, Homo sapiens; identical to SEQ ID NO: 41957
  chr8:135301251-135301285
  Hypo

SEQ ID NO: 130066 - DNA, 30 bp, Homo sapiens; identical to SEQ ID NO: 98728
  chr8:135319421-135319451
  Hypo

SEQ ID NO: 130067 - DNA, 23 bp, Homo sapiens
  chr8:135477507-135477530
  Hypo
ggagtactcgccctgcagtactt

SEQ ID NO: 130068 - DNA, 128 bp, Homo sapiens; identical to SEQ ID NO: 98730
  chr8:135732756-135732884
  Hyper

SEQ ID NO: 130069 - DNA, 18 bp, Homo sapiens
  chr8:135950097-135950115
  Hypo
aaccgaaaaaacaaataa

SEQ ID NO: 130070 - DNA, 230 bp, Homo sapiens; identical to SEQ ID NO: 98733
  chr8:136469072-136469302
  Hyper

SEQ ID NO: 130071 - DNA, 158 bp, Homo sapiens; identical to SEQ ID NO: 98734
  chr8:136470155-136470313
  Hyper

SEQ ID NO: 130072 - DNA, 19 bp, Homo sapiens
  chr8:136858149-136858168
  Hypo
gatggctgggagtggcggc

SEQ ID NO: 130073 - DNA, 23 bp, Homo sapiens
  chr8:136865750-136865773
  Hypo
ttcctattcggccatctataatt

SEQ ID NO: 130074 - DNA, 30 bp, Homo sapiens; identical to SEQ ID NO: 98738
  chr8:137746178-137746208
  Hypo

SEQ ID NO: 130075 - DNA, 27 bp, Homo sapiens
  chr8:138625594-138625621
  Hypo
tctttaaaactgatacgtggggctggg

SEQ ID NO: 130076 - DNA, 18 bp, Homo sapiens
  chr8:138909127-138909145
  Hypo
ctacaaggactcattcgt

SEQ ID NO: 130077 - DNA, 154 bp, Homo sapiens; identical to SEQ ID NO: 41958
  chr8:138910227-138910381
  Hypo

SEQ ID NO: 130078 - DNA, 99 bp, Homo sapiens; identical to SEQ ID NO: 98743
  chr8:139046831-139046930
  Hypo

SEQ ID NO: 130079 - DNA, 30 bp, Homo sapiens; identical to SEQ ID NO: 98744
  chr8:139155605-139155635
  Hypo

SEQ ID NO: 130080 - DNA, 599 bp, Homo sapiens
  chr8:139508757-139509356
  Hyper
gagactggggaaaatcgagggagataaaccacattttgcggcggaatcgctgttccgtgacagaaagccatccaactggcaaccacgcttgcagaagcgtcactaccaccgacgagagagttttgcagctgccgaccccgaagcgctctcacctacctgtctccactgcagggctcccctctctctcccccgggggccgcgctcctgggtccctctctctcctctttcgccgtctctggccgccaacagttgcggcggcggcggcggcgggcggactggggagtccgcagcacctgcgagctggtgttgggtccccgcggcgaggctgcctggaggaggagcgagcggatgctgccctcgcccgccgccgccggtgctgatgcggttgctatggttatggaaccccgcaactgcccccctctccgtgcaacagctgcccggccgcggcctccgggcagccccagcgagcaggcgccaggacgcgaggctgtcagcgcggtcgggggaacgcagccgccagcgccgcaagaaagcaaggaccgaccggctgcgcccgcgccgctgggctggcgcctcccgggctgcgctcacctctggcg

SEQ ID NO: 130081 - DNA, 284 bp, Homo sapiens
  chr8:139509651-139509935
  Hyper
ccctcccagactgaccggcgcgagcatgctcagtccccgcggcggggctcccctctcgagccaagaccccaggcctcgggcaggaaaagggtccctgcagatatccgggggcggggcgcggcggagaactggctgggaggggactgttgaacttggaagagaagcccaggcaacaagtagatgcctgagaaagggtaaaagcgctgagcaacccatacctccaatgcgaagtcagcagtggccttcaaccagccagccggcccgtcatccgatgggctcctcac

SEQ ID NO: 130082 - DNA, 220 bp, Homo sapiens; identical to SEQ ID NO: 98748
  chr8:139667039-139667259
  Hypo

SEQ ID NO: 130083 - DNA, 30 bp, Homo sapiens; identical to SEQ ID NO: 98749
  chr8:139894041-139894071
  Hypo

SEQ ID NO: 130084 - DNA, 37 bp, Homo sapiens; identical to SEQ ID NO: 98750
  chr8:139908925-139908962
  Hypo

SEQ ID NO: 130085 - DNA, 40 bp, Homo sapiens; identical to SEQ ID NO: 98751
  chr8:139926210-139926250
  Hyper

SEQ ID NO: 130086 - DNA, 275 bp, Homo sapiens; identical to SEQ ID NO: 98752
  chr8:139926455-139926730
  Hyper

SEQ ID NO: 130087 - DNA, 207 bp, Homo sapiens; identical to SEQ ID NO: 98754
  chr8:140417247-140417454
  Hypo

SEQ ID NO: 130088 - DNA, 30 bp, Homo sapiens; identical to SEQ ID NO: 98755
  chr8:140616896-140616926
  Hypo

SEQ ID NO: 130089 - DNA, 114 bp, Homo sapiens; identical to SEQ ID NO: 98756
  chr8:140630523-140630637
  Hypo

SEQ ID NO: 130090 - DNA, 30 bp, Homo sapiens; identical to SEQ ID NO: 41959
  chr8:140630956-140630986
  Hypo

SEQ ID NO: 130091 - DNA, 106 bp, Homo sapiens; identical to SEQ ID NO: 98758
  chr8:140643342-140643448
  Hyper

SEQ ID NO: 130092 - DNA, 30 bp, Homo sapiens; identical to SEQ ID NO: 98759
  chr8:140657025-140657055
  Hypo

SEQ ID NO: 130093 - DNA, 37 bp, Homo sapiens; identical to SEQ ID NO: 41960
  chr8:140691457-140691494
  Hypo

SEQ ID NO: 130094 - DNA, 1904 bp, Homo sapiens
  chr8:140714444-140716348
  Hyper
ggggcccaggggctacggagggtcagtgcctctcacgccccaggcgcactcccctgccacctgagtccctctaggagccatgggtgccaggccagccctctccaactcccagagaggtagtaagtgtaaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagcccggcgcggcgcgctcagccgcctccccggactcctcccggggcgcgggagcccagcggcgcgcccagcccttacctatggtggtgatgaccgtgatcgcaaagtagaaggagccggcgaatttccactggacgccggcgcggtgcggttccgactgcaggatcaccagctccagctgccggtagtcctcgctgctgatgttgtacttccccttgatccggatctcctcggctttgagtttctcctcctcgcgcatctcgtggtccgactcgagggcgtcgaacacggcggcgcccaccagcaggtaggtgaaggtgcagacgatgagggacagagtccgcacgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcggctggcggggcaggggcggcgcgggcccgggctcagccgagaaggcggacaggcacaggaggctgctcgagcgccggggccaggcgtccgggaaccccgacaccctgcgccagacccggccgaagcagcccgccccactgcgcagggccatgcagggcggccccgctgggtaccgcgcgggccttgctgccctccgcaccccgccccccgctcccgcgggaaacgcagggacgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcgcgcccagcgcccacccgggcgcgcgggtgcgcagcggggtccccgccgggcgtcggccggtgcgcgaagtttgctcggctcaacccccaaggcgcgggagcggggcgcggccccaggacggcagggaccgcgatggagcggcttcgggggcggccgggggacggcgcggtggcggtcggccagcccgctcctccgggggcggcgggcgcggcggcggcggcgggaggggtcccgcgggcctcgcggagcagcggggcggacgcgggcgcatgagccgcgcgggggtcggggccctccggcgtccgggcgtcccgggaggcggccgccgcgctggtctgccccgggcgctacgtgcgtgcgcgccgttgggagcccgaatgtgt

SEQ ID NO: 130095 - DNA, 44 bp, Homo sapiens; identical to SEQ ID NO: 98765
  chr8:140716408-140716452
  Hyper

SEQ ID NO: 130096 - DNA, 511 bp, Homo sapiens; identical to SEQ ID NO: 98766
  chr8:140716655-140717166
  Hyper

SEQ ID NO: 130097 - DNA, 150 bp, Homo sapiens; identical to SEQ ID NO: 98767
  chr8:140717226-140717376
  Hyper

SEQ ID NO: 130098 - DNA, 196 bp, Homo sapiens; identical to SEQ ID NO: 98768
  chr8:140717664-140717860
  Hyper

SEQ ID NO: 130099 - DNA, 34 bp, Homo sapiens; identical to SEQ ID NO: 98769
  chr8:140751338-140751372
  Hypo

SEQ ID NO: 130100 - DNA, 37 bp, Homo sapiens; identical to SEQ ID NO: 98770
  chr8:140788728-140788765
  Hypo

SEQ ID NO: 130101 - DNA, 186 bp, Homo sapiens; identical to SEQ ID NO: 98771
  chr8:140818684-140818870
  Hypo

SEQ ID NO: 130102 - DNA, 281 bp, Homo sapiens; identical to SEQ ID NO: 98772
  chr8:140834115-140834396
  Hypo

SEQ ID NO: 130103 - DNA, 140 bp, Homo sapiens; identical to SEQ ID NO: 98773
  chr8:140834841-140834981
  Hypo

SEQ ID NO: 130104 - DNA, 30 bp, Homo sapiens; identical to SEQ ID NO: 98774
  chr8:140869275-140869305
  Hypo

SEQ ID NO: 130105 - DNA, 30 bp, Homo sapiens; identical to SEQ ID NO: 98775
  chr8:140869920-140869950
  Hypo

SEQ ID NO: 130106 - DNA, 315 bp, Homo sapiens; identical to SEQ ID NO: 98776
  chr8:140963081-140963396
  Hypo

SEQ ID NO: 130107 - DNA, 30 bp, Homo sapiens; identical to SEQ ID NO: 98777
  chr8:140971345-140971375
  Hypo

SEQ ID NO: 130108 - DNA, 30 bp, Homo sapiens; identical to SEQ ID NO: 41964
  chr8:141018127-141018157
  Hypo

SEQ ID NO: 130109 - DNA, 30 bp, Homo sapiens; identical to SEQ ID NO: 41965
  chr8:141054547-141054577
  Hypo

SEQ ID NO: 130110 - DNA, 41 bp, Homo sapiens; identical to SEQ ID NO: 41966
  chr8:141106960-141107001
  Hypo

SEQ ID NO: 130111 - DNA, 323 bp, Homo sapiens; identical to SEQ ID NO: 98781
  chr8:141107540-141107863
  Hypo

SEQ ID NO: 130112 - DNA, 30 bp, Homo sapiens; identical to SEQ ID NO: 98782
  chr8:141126859-141126889
  Hypo

SEQ ID NO: 130113 - DNA, 30 bp, Homo sapiens; identical to SEQ ID NO: 98783
  chr8:141159257-141159287
  Hypo

SEQ ID NO: 130114 - DNA, 203 bp, Homo sapiens; identical to SEQ ID NO: 98784
  chr8:141159746-141159949
  Hypo

SEQ ID NO: 130115 - DNA, 284 bp, Homo sapiens; identical to SEQ ID NO: 98785
  chr8:141202454-141202738
  Hypo

SEQ ID NO: 130116 - DNA, 30 bp, Homo sapiens; identical to SEQ ID NO: 98786
  chr8:141219253-141219283
  Hypo

SEQ ID NO: 130117 - DNA, 70 bp, Homo sapiens; identical to SEQ ID NO: 98787
  chr8:141249551-141249621
  Hypo

SEQ ID NO: 130118 - DNA, 113 bp, Homo sapiens; identical to SEQ ID NO: 98788
  chr8:141347719-141347832
  Hypo

SEQ ID NO: 130119 - DNA, 196 bp, Homo sapiens; identical to SEQ ID NO: 41971
  chr8:141466557-141466753
  Hypo

SEQ ID NO: 130120 - DNA, 30 bp, Homo sapiens; identical to SEQ ID NO: 98790
  chr8:141503865-141503895
  Hypo

SEQ ID NO: 130121 - DNA, 30 bp, Homo sapiens; identical to SEQ ID NO: 98791
  chr8:141559694-141559724
  Hypo

SEQ ID NO: 130122 - DNA, 215 bp, Homo sapiens; identical to SEQ ID NO: 98792
  chr8:141566731-141566946
  Hypo

SEQ ID NO: 130123 - DNA, 80 bp, Homo sapiens; identical to SEQ ID NO: 98793
  chr8:141577436-141577516
  Hypo

SEQ ID NO: 130124 - DNA, 171 bp, Homo sapiens; identical to SEQ ID NO: 98794
  chr8:141588008-141588179
  Hypo

SEQ ID NO: 130125 - DNA, 30 bp, Homo sapiens; identical to SEQ ID NO: 98795
  chr8:141594621-141594651
  Hypo

SEQ ID NO: 130126 - DNA, 55 bp, Homo sapiens; identical to SEQ ID NO: 98796
  chr8:141594857-141594912
  Hypo

SEQ ID NO: 130127 - DNA, 368 bp, Homo sapiens; identical to SEQ ID NO: 98797
  chr8:141596819-141597187
  Hypo

SEQ ID NO: 130128 - DNA, 30 bp, Homo sapiens; identical to SEQ ID NO: 98798
  chr8:141598051-141598081
  Hypo

SEQ ID NO: 130129 - DNA, 30 bp, Homo sapiens; identical to SEQ ID NO: 98799
  chr8:141599723-141599753
  Hypo

SEQ ID NO: 130130 - DNA, 109 bp, Homo sapiens; identical to SEQ ID NO: 98800
  chr8:141600175-141600284
  Hypo

SEQ ID NO: 130131 - DNA, 52 bp, Homo sapiens; identical to SEQ ID NO: 98801
  chr8:141602350-141602402
  Hypo

SEQ ID NO: 130132 - DNA, 38 bp, Homo sapiens; identical to SEQ ID NO: 98802
  chr8:141624393-141624431
  Hypo

SEQ ID NO: 130133 - DNA, 32 bp, Homo sapiens; identical to SEQ ID NO: 98803
  chr8:141629973-141630005
  Hypo

SEQ ID NO: 130134 - DNA, 53 bp, Homo sapiens; identical to SEQ ID NO: 98804
  chr8:141632257-141632310
  Hypo

SEQ ID NO: 130135 - DNA, 40 bp, Homo sapiens; identical to SEQ ID NO: 98805
  chr8:141633613-141633653
  Hypo

SEQ ID NO: 130136 - DNA, 68 bp, Homo sapiens; identical to SEQ ID NO: 98806
  chr8:141634252-141634320
  Hypo

SEQ ID NO: 130137 - DNA, 30 bp, Homo sapiens; identical to SEQ ID NO: 98807
  chr8:141638210-141638240
  Hypo

SEQ ID NO: 130138 - DNA, 30 bp, Homo sapiens; identical to SEQ ID NO: 98809
  chr8:142095370-142095400
  Hypo

SEQ ID NO: 130139 - DNA, 94 bp, Homo sapiens; identical to SEQ ID NO: 98810
  chr8:142119106-142119200
  Hypo

SEQ ID NO: 130140 - DNA, 30 bp, Homo sapiens; identical to SEQ ID NO: 98811
  chr8:142168132-142168162
  Hypo

SEQ ID NO: 130141 - DNA, 30 bp, Homo sapiens; identical to SEQ ID NO: 98812
  chr8:142190839-142190869
  Hypo

SEQ ID NO: 130142 - DNA, 54 bp, Homo sapiens; identical to SEQ ID NO: 98813
  chr8:142231648-142231702
  Hypo

SEQ ID NO: 130143 - DNA, 176 bp, Homo sapiens; identical to SEQ ID NO: 98814
  chr8:142242938-142243114
  Hypo

SEQ ID NO: 130144 - DNA, 266 bp, Homo sapiens; identical to SEQ ID NO: 98815
  chr8:142243948-142244214
  Hypo

SEQ ID NO: 130145 - DNA, 30 bp, Homo sapiens; identical to SEQ ID NO: 98816
  chr8:142260889-142260919
  Hypo

SEQ ID NO: 130146 - DNA, 95 bp, Homo sapiens; identical to SEQ ID NO: 98817
  chr8:142290791-142290886
  Hypo

SEQ ID NO: 130147 - DNA, 151 bp, Homo sapiens; identical to SEQ ID NO: 98818
  chr8:142292552-142292703
  Hypo

SEQ ID NO: 130148 - DNA, 30 bp, Homo sapiens; identical to SEQ ID NO: 98819
  chr8:142296602-142296632
  Hypo

SEQ ID NO: 130149 - DNA, 43 bp, Homo sapiens; identical to SEQ ID NO: 98820
  chr8:142297555-142297598
  Hypo

SEQ ID NO: 130150 - DNA, 245 bp, Homo sapiens; identical to SEQ ID NO: 98821
  chr8:142299062-142299307
  Hypo

SEQ ID NO: 130151 - DNA, 26 bp, Homo sapiens
  chr8:142313508-142313534
  Hypo
gattgcaggaacgagcctctgtgccc

SEQ ID NO: 130152 - DNA, 30 bp, Homo sapiens; identical to SEQ ID NO: 41984
  chr8:142323052-142323082
  Hypo

SEQ ID NO: 130153 - DNA, 30 bp, Homo sapiens; identical to SEQ ID NO: 98824
  chr8:142356494-142356524
  Hypo

SEQ ID NO: 130154 - DNA, 162 bp, Homo sapiens; identical to SEQ ID NO: 98825
  chr8:142361169-142361331
  Hypo

SEQ ID NO: 130155 - DNA, 64 bp, Homo sapiens; identical to SEQ ID NO: 98827
  chr8:142367760-142367824
  Hypo

SEQ ID NO: 130156 - DNA, 30 bp, Homo sapiens; identical to SEQ ID NO: 98828
  chr8:142368111-142368141
  Hypo

SEQ ID NO: 130157 - DNA, 30 bp, Homo sapiens; identical to SEQ ID NO: 98829
  chr8:142369212-142369242
  Hyper

SEQ ID NO: 130158 - DNA, 30 bp, Homo sapiens; identical to SEQ ID NO: 98830
  chr8:142405274-142405304
  Hypo

SEQ ID NO: 130159 - DNA, 30 bp, Homo sapiens; identical to SEQ ID NO: 98831
  chr8:142405762-142405792
  Hypo

SEQ ID NO: 130160 - DNA, 30 bp, Homo sapiens; identical to SEQ ID NO: 98832
  chr8:142419859-142419889
  Hypo

SEQ ID NO: 130161 - DNA, 30 bp, Homo sapiens; identical to SEQ ID NO: 98833
  chr8:142424065-142424095
  Hypo

SEQ ID NO: 130162 - DNA, 105 bp, Homo sapiens; identical to SEQ ID NO: 98834
  chr8:142427595-142427700
  Hyper

SEQ ID NO: 130163 - DNA, 265 bp, Homo sapiens
  chr8:142428027-142428292
  Hyper
gcggcggaggggcggcgccccgacccagggccagcaccgtgggcaccgccaggccggcgcgtatggaggcggtgggacgcctgcggcgcgggtgagcctggcaggtggggacgcggcggacccaggccttccgggaccccagccccgccggggaggaggtggcgccctccggagggctgggcgggagccccgctggcacccagggagggggccgcgccccttaccacgaccccacccgcgactggttccccgggactccccagag

SEQ ID NO: 130164 - DNA, 155 bp, Homo sapiens; identical to SEQ ID NO: 98836
  chr8:142432225-142432380
  Hypo

SEQ ID NO: 130165 - DNA, 116 bp, Homo sapiens; identical to SEQ ID NO: 98837
  chr8:142436166-142436282
  Hypo

SEQ ID NO: 130166 - DNA, 149 bp, Homo sapiens; identical to SEQ ID NO: 98838
  chr8:142439200-142439349
  Hypo

SEQ ID NO: 130167 - DNA, 30 bp, Homo sapiens; identical to SEQ ID NO: 98839
  chr8:142444722-142444752
  Hypo

SEQ ID NO: 130168 - DNA, 30 bp, Homo sapiens; identical to SEQ ID NO: 98840
  chr8:142445528-142445558
  Hypo

SEQ ID NO: 130169 - DNA, 162 bp, Homo sapiens; identical to SEQ ID NO: 98841
  chr8:142452230-142452392
  Hypo

SEQ ID NO: 130170 - DNA, 30 bp, Homo sapiens; identical to SEQ ID NO: 98842
  chr8:142453296-142453326
  Hypo

SEQ ID NO: 130171 - DNA, 65 bp, Homo sapiens; identical to SEQ ID NO: 98843
  chr8:142461734-142461799
  Hypo

SEQ ID NO: 130172 - DNA, 54 bp, Homo sapiens; identical to SEQ ID NO: 98844
  chr8:142501450-142501504
  Hypo

SEQ ID NO: 130173 - DNA, 830 bp, Homo sapiens
  chr8:142528212-142529042
  Hyper
ctggccacctctcttcgcgcccggcctcctggtctcccgcctgcgcgggccgctcccggccctccccgccctgccgggcgttcactgtcccctccgcccgcaggtcccgcggcgcccccggagcccgccttcccggacatctacggcggggacgcgcagctctgggaggcgcatttccgcggcatcgggcgcgcctaccgcgcgctgggcaagcaggacgacttcgccatccgcgtgctcaccgagaacttcacgctgcccttcccgttcgcctggccgccggggtccgaccccgcctgcgggccgctcttctacgacccccgcgaccgcgcagacttcgacttcctgctgcgcggccccggagcttcgcccccagcgctgctgcggcccctgcacgccacggcccaggcagcgatgcgcaagcggcgcctggagcggctggccctgagctgcgcccgcgcgcggggcccgggcccggcctcgtcctgctgctgcccggccccgccgccgccttcccggagcccgaggccagcgcttccagcgacggcacccccaggctggcccaggccccgccgctgccccgagagcgaacagaataaataaagagtttccccagctctcccgcgcccggcgcttttctgcacacactccgacaggcctgggcggctgggcccggcggggaaggggggcggtgggacggtgggacggtggaccaggaacccaactgggacaccgggccaggccgggcagcggtgggcctgggaagccgcatgggtccgaaggtgcagtgaacatattcgcagtagaaacggtgacggaggcaggccctc

SEQ ID NO: 130174 - DNA, 200 bp, Homo sapiens; identical to SEQ ID NO: 98850
  chr8:142535307-142535507
  Hypo

SEQ ID NO: 130175 - DNA, 55 bp, Homo sapiens; identical to SEQ ID NO: 98851
  chr8:142547012-142547067
  Hypo

SEQ ID NO: 130176 - DNA, 144 bp, Homo sapiens; identical to SEQ ID NO: 41991
  chr8:142553829-142553973
  Hypo

SEQ ID NO: 130177 - DNA, 185 bp, Homo sapiens; identical to SEQ ID NO: 98853
  chr8:142558807-142558992
  Hypo

SEQ ID NO: 130178 - DNA, 62 bp, Homo sapiens; identical to SEQ ID NO: 98854
  chr8:142560165-142560227
  Hypo

SEQ ID NO: 130179 - DNA, 296 bp, Homo sapiens; identical to SEQ ID NO: 98855
  chr8:142568543-142568839
  Hypo

SEQ ID NO: 130180 - DNA, 172 bp, Homo sapiens; identical to SEQ ID NO: 98856
  chr8:142583056-142583228
  Hypo

SEQ ID NO: 130181 - DNA, 171 bp, Homo sapiens; identical to SEQ ID NO: 98857
  chr8:142593564-142593735
  Hypo

SEQ ID NO: 130182 - DNA, 30 bp, Homo sapiens; identical to SEQ ID NO: 98858
  chr8:142603404-142603434
  Hypo

SEQ ID NO: 130183 - DNA, 132 bp, Homo sapiens; identical to SEQ ID NO: 98859
  chr8:142622154-142622286
  Hypo

SEQ ID NO: 130184 - DNA, 41 bp, Homo sapiens; identical to SEQ ID NO: 98860
  chr8:142630247-142630288
  Hypo

SEQ ID NO: 130185 - DNA, 30 bp, Homo sapiens; identical to SEQ ID NO: 98861
  chr8:142633631-142633661
  Hypo

SEQ ID NO: 130186 - DNA, 43 bp, Homo sapiens; identical to SEQ ID NO: 98862
  chr8:142659067-142659110
  Hypo

SEQ ID NO: 130187 - DNA, 34 bp, Homo sapiens; identical to SEQ ID NO: 98863
  chr8:142680131-142680165
  Hypo

SEQ ID NO: 130188 - DNA, 136 bp, Homo sapiens; identical to SEQ ID NO: 98864
  chr8:142694812-142694948
  Hypo

SEQ ID NO: 130189 - DNA, 193 bp, Homo sapiens; identical to SEQ ID NO: 41998
  chr8:142706678-142706871
  Hypo

SEQ ID NO: 130190 - DNA, 46 bp, Homo sapiens; identical to SEQ ID NO: 98866
  chr8:142738298-142738344
  Hypo

SEQ ID NO: 130191 - DNA, 196 bp, Homo sapiens; identical to SEQ ID NO: 98867
  chr8:142841690-142841886
  Hypo

SEQ ID NO: 130192 - DNA, 202 bp, Homo sapiens; identical to SEQ ID NO: 98868
  chr8:142859982-142860184
  Hypo

SEQ ID NO: 130193 - DNA, 30 bp, Homo sapiens; identical to SEQ ID NO: 98869
  chr8:142881166-142881196
  Hypo

SEQ ID NO: 130194 - DNA, 42 bp, Homo sapiens; identical to SEQ ID NO: 98870
  chr8:142895890-142895932
  Hypo

SEQ ID NO: 130195 - DNA, 159 bp, Homo sapiens; identical to SEQ ID NO: 98871
  chr8:142939132-142939291
  Hypo

SEQ ID NO: 130196 - DNA, 147 bp, Homo sapiens; identical to SEQ ID NO: 98872
  chr8:142984512-142984659
  Hypo

SEQ ID NO: 130197 - DNA, 30 bp, Homo sapiens; identical to SEQ ID NO: 98873
  chr8:143013191-143013221
  Hypo

SEQ ID NO: 130198 - DNA, 102 bp, Homo sapiens; identical to SEQ ID NO: 98874
  chr8:143054769-143054871
  Hypo

SEQ ID NO: 130199 - DNA, 162 bp, Homo sapiens; identical to SEQ ID NO: 98875
  chr8:143054991-143055153
  Hypo

SEQ ID NO: 130200 - DNA, 30 bp, Homo sapiens; identical to SEQ ID NO: 98876
  chr8:143055995-143056025
  Hypo

SEQ ID NO: 130201 - DNA, 280 bp, Homo sapiens; identical to SEQ ID NO: 98877
  chr8:143088493-143088773
  Hypo

SEQ ID NO: 130202 - DNA, 68 bp, Homo sapiens; identical to SEQ ID NO: 42003
  chr8:143088999-143089067
  Hypo

SEQ ID NO: 130203 - DNA, 85 bp, Homo sapiens; identical to SEQ ID NO: 98879
  chr8:143090651-143090736
  Hypo

SEQ ID NO: 130204 - DNA, 33 bp, Homo sapiens; identical to SEQ ID NO: 15178
  chr8:143097424-143097457
  Hypo

SEQ ID NO: 130205 - DNA, 399 bp, Homo sapiens; identical to SEQ ID NO: 98881
  chr8:143105067-143105466
  Hypo

SEQ ID NO: 130206 - DNA, 30 bp, Homo sapiens; identical to SEQ ID NO: 98882
  chr8:143105753-143105783
  Hypo

SEQ ID NO: 130207 - DNA, 57 bp, Homo sapiens; identical to SEQ ID NO: 98883
  chr8:143128744-143128801
  Hypo

SEQ ID NO: 130208 - DNA, 30 bp, Homo sapiens; identical to SEQ ID NO: 42008
  chr8:143156215-143156245
  Hypo

SEQ ID NO: 130209 - DNA, 30 bp, Homo sapiens; identical to SEQ ID NO: 98885
  chr8:143162428-143162458
  Hypo

SEQ ID NO: 130210 - DNA, 150 bp, Homo sapiens; identical to SEQ ID NO: 98886
  chr8:143171132-143171282
  Hypo

SEQ ID NO: 130211 - DNA, 30 bp, Homo sapiens; identical to SEQ ID NO: 98887
  chr8:143193094-143193124
  Hypo

SEQ ID NO: 130212 - DNA, 157 bp, Homo sapiens; identical to SEQ ID NO: 98888
  chr8:143198927-143199084
  Hypo

SEQ ID NO: 130213 - DNA, 30 bp, Homo sapiens; identical to SEQ ID NO: 98889
  chr8:143199865-143199895
  Hypo

SEQ ID NO: 130214 - DNA, 30 bp, Homo sapiens; identical to SEQ ID NO: 98890
  chr8:143200728-143200758
  Hypo

SEQ ID NO: 130215 - DNA, 175 bp, Homo sapiens; identical to SEQ ID NO: 98891
  chr8:143210674-143210849
  Hypo

SEQ ID NO: 130216 - DNA, 66 bp, Homo sapiens; identical to SEQ ID NO: 42012
  chr8:143217605-143217671
  Hypo

SEQ ID NO: 130217 - DNA, 87 bp, Homo sapiens; identical to SEQ ID NO: 98893
  chr8:143223873-143223960
  Hypo

SEQ ID NO: 130218 - DNA, 30 bp, Homo sapiens; identical to SEQ ID NO: 98894
  chr8:143237748-143237778
  Hypo

SEQ ID NO: 130219 - DNA, 181 bp, Homo sapiens; identical to SEQ ID NO: 98895
  chr8:143246191-143246372
  Hypo

SEQ ID NO: 130220 - DNA, 49 bp, Homo sapiens; identical to SEQ ID NO: 98896
  chr8:143251863-143251912
  Hypo

SEQ ID NO: 130221 - DNA, 30 bp, Homo sapiens; identical to SEQ ID NO: 98897
  chr8:143258355-143258385
  Hypo

SEQ ID NO: 130222 - DNA, 30 bp, Homo sapiens; identical to SEQ ID NO: 42013
  chr8:143265172-143265202
  Hypo

SEQ ID NO: 130223 - DNA, 119 bp, Homo sapiens; identical to SEQ ID NO: 98899
  chr8:143314588-143314707
  Hypo

SEQ ID NO: 130224 - DNA, 389 bp, Homo sapiens; identical to SEQ ID NO: 98900
  chr8:143317093-143317482
  Hypo

SEQ ID NO: 130225 - DNA, 54 bp, Homo sapiens; identical to SEQ ID NO: 98901
  chr8:143319314-143319368
  Hypo

SEQ ID NO: 130226 - DNA, 50 bp, Homo sapiens; identical to SEQ ID NO: 98902
  chr8:143326089-143326139
  Hypo

SEQ ID NO: 130227 - DNA, 47 bp, Homo sapiens; identical to SEQ ID NO: 98903
  chr8:143329464-143329511
  Hypo

SEQ ID NO: 130228 - DNA, 132 bp, Homo sapiens; identical to SEQ ID NO: 98904
  chr8:143332980-143333112
  Hypo

SEQ ID NO: 130229 - DNA, 346 bp, Homo sapiens; identical to SEQ ID NO: 98905
  chr8:143333322-143333668
  Hypo

SEQ ID NO: 130230 - DNA, 159 bp, Homo sapiens; identical to SEQ ID NO: 98906
  chr8:143334538-143334697
  Hypo

SEQ ID NO: 130231 - DNA, 142 bp, Homo sapiens; identical to SEQ ID NO: 98907
  chr8:143386798-143386940
  Hypo

SEQ ID NO: 130232 - DNA, 324 bp, Homo sapiens; identical to SEQ ID NO: 98908
  chr8:143405647-143405971
  Hypo

SEQ ID NO: 130233 - DNA, 313 bp, Homo sapiens; identical to SEQ ID NO: 98909
  chr8:143436977-143437290
  Hypo

SEQ ID NO: 130234 - DNA, 52 bp, Homo sapiens; identical to SEQ ID NO: 42023
  chr8:143463629-143463681
  Hypo

SEQ ID NO: 130235 - DNA, 492 bp, Homo sapiens
  chr8:143509151-143509643
  Hypo
gctgggattggagcccgccctgcctcggggaagatcctcgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtctctctctagctgccaacggcgccttcaccagacacgcccggcaccaccttccaggtcagcagtcccagccctgcgtatcggaggcctgctctcccacagcgtccacagtcactgggccaggctcgcacctgtgaggggccaggacccataccggagcccggcgaggctccctcggccaccctctggg

SEQ ID NO: 130236 - DNA, 94 bp, Homo sapiens; identical to SEQ ID NO: 98913
  chr8:143511468-143511562
  Hypo

SEQ ID NO: 130237 - DNA, 16 bp, Homo sapiens
  chr8:143518352-143518368
  Hypo
gtagagttggagtcac

SEQ ID NO: 130238 - DNA, 1302 bp, Homo sapiens; identical to SEQ ID NO: 98915
  chr8:143530469-143531771
  Hyper

SEQ ID NO: 130239 - DNA, 2779 bp, Homo sapiens
  chr8:143531978-143534757
  Hyper
gacattgtaagggcccgagacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcctcgggagggggcggcggagctgagaatcaccgcgaagcgatgcgaccgggagggcttgacggaggctgcggctccgagcccgcgtccctcctcctggccgcggcggctcctgcttggccactccccggcagcctgaagagaacgcctaatctggcaccccagccccaggccgctgggcaccttacccctttccacttttattttgggcttctaagtttcttggagcgcaggcgcctaggctgggacccgaagagccctaagccagccctctttcagcacccgtccccgccgcgacctccccgttcttcctccgggtctggggcgcagattcctgggctgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccacgccctcccttcggctcgctagctgctccttggcgctgctttcagacttgttgcgcctcgatctggggggcagaaggctggcccgggagacccggcggctgagggccgagccgcgaagcccagggatgcgccagagaggcgcgcggctccgcgggtgggcgctgcgctggggggctcgagcctggggtttgccgcctccgatcccagggacgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctccaggcccaggcggccggcgcggggccgcagtggcggaaggcggagggccggcgcgctgccgctgactgccgggagagggcgcccgcaccgcgcccgcgcggccctgcccgccccttccgtctcctccgcgcctggcccgcggctccggccccatcttgggcagccccggccgccacctccctcccgcccgcccgcccgcccgctcgctcgctcgctcgccgtccgctcccgccgccgggtcccgtgacgcgcctcgcgtctcggccggagcccccctcgccggcccggcccggtccccgtgtgcggtgcgctggcgtgagcgcgcgtttgcgtgctggtgtccatgtgtggcgcgcatgcacgtgcgtgcccgtccgggaggctgggggcacgtgtgtgcaggcatgcagacttgcacatgtgtgtgcgtgacgggggcgggtctcgcgccggtgtggccccggatggcaggatttagtcaaaccccgttttaccgtcggctctggctctgggctgcccccgggtctgctctgtgtgcacgggatggacccctg

SEQ ID NO: 130240 - DNA, 77 bp, Homo sapiens; identical to SEQ ID NO: 98920
  chr8:143535787-143535864
  Hypo

SEQ ID NO: 130241 - DNA, 49 bp, Homo sapiens; identical to SEQ ID NO: 42027
  chr8:143538439-143538488
  Hypo

SEQ ID NO: 130242 - DNA, 30 bp, Homo sapiens; identical to SEQ ID NO: 98922
  chr8:143539356-143539386
  Hypo

SEQ ID NO: 130243 - DNA, 163 bp, Homo sapiens; identical to SEQ ID NO: 98923
  chr8:143543201-143543364
  Hypo

SEQ ID NO: 130244 - DNA, 149 bp, Homo sapiens
  chr8:143545558-143545707
  Hyper
gatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaa

SEQ ID NO: 130245 - DNA, 47 bp, Homo sapiens
  chr8:143545916-143545963
  Hyper
ttcgacgaggtgctgcggctctgcgacccctccgcacccctggcctt

SEQ ID NO: 130246 - DNA, 157 bp, Homo sapiens; identical to SEQ ID NO: 98924
  chr8:143550641-143550798
  Hypo

SEQ ID NO: 130247 - DNA, 93 bp, Homo sapiens; identical to SEQ ID NO: 98925
  chr8:143555636-143555729
  Hypo

SEQ ID NO: 130248 - DNA, 207 bp, Homo sapiens; identical to SEQ ID NO: 98926
  chr8:143556062-143556269
  Hypo

SEQ ID NO: 130249 - DNA, 357 bp, Homo sapiens; identical to SEQ ID NO: 42029
  chr8:143557723-143558080
  Hypo

SEQ ID NO: 130250 - DNA, 254 bp, Homo sapiens; identical to SEQ ID NO: 98928
  chr8:143558389-143558643
  Hypo

SEQ ID NO: 130251 - DNA, 499 bp, Homo sapiens; identical to SEQ ID NO: 98929
  chr8:143560990-143561489
  Hypo

SEQ ID NO: 130252 - DNA, 154 bp, Homo sapiens; identical to SEQ ID NO: 98930
  chr8:143567944-143568098
  Hypo

SEQ ID NO: 130253 - DNA, 152 bp, Homo sapiens; identical to SEQ ID NO: 98931
  chr8:143572706-143572858
  Hypo

SEQ ID NO: 130254 - DNA, 30 bp, Homo sapiens; identical to SEQ ID NO: 42033
  chr8:143573208-143573238
  Hypo

SEQ ID NO: 130255 - DNA, 220 bp, Homo sapiens; identical to SEQ ID NO: 98933
  chr8:143587271-143587491
  Hypo

SEQ ID NO: 130256 - DNA, 1264 bp, Homo sapiens
  chr8:143591423-143592687
  Hyper
aggaggaagaggaggcggaggaggaagaggaggaggtggaggaggaagaacaggaggaggaggttgggggtggagaggaggaggaggggtttgcagagcaggtcagtccctggtgcaccaagtaacaagtcctgtgcttaaatgcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggagcggaccctcgccgcgctccgaacccgccccgcgcccccaggccacacccggctcgcaccctccccgctccacgtgcgcccacgcgcccctccgggcctccccctccttcccgcgcgggccgggggcgcgggccccggaggagctgggggcggcgggggcgcggggcgggcgactgccgggccccgggccagctctcgccccccgccccgcccccgatcgctcggctcccccgcccggcgctccctcgggctgcgctccgcggctctcggcggcggcggcggcgggcgcagagcgcggcatgggcgcccgggccgcggggcctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcccgtgtcccgcccgcccccagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcggtgagaccccggccgggccggcgggaggggcgccgggcaggggcgcgggcgggggctgccggcgggcctgcgggtggggagggcccgcacccgtcctgtcccggaggggtcgctgtggcccgcagccgccgtggcctggcccggccggcggggtccatgcgcctctggagagggtgggtgggcgccgagcgggtggcagtgtggagttggagacgggcctgggaggagtcgggacccccggaaagtggctgat

SEQ ID NO: 130257 - DNA, 306 bp, Homo sapiens; identical to SEQ ID NO: 98939
  chr8:143595515-143595821
  Hypo

SEQ ID NO: 130258 - DNA, 171 bp, Homo sapiens; identical to SEQ ID NO: 98940
  chr8:143598967-143599138
  Hypo

SEQ ID NO: 130259 - DNA, 30 bp, Homo sapiens; identical to SEQ ID NO: 42037
  chr8:143599572-143599602
  Hypo

SEQ ID NO: 130260 - DNA, 30 bp, Homo sapiens; identical to SEQ ID NO: 98942
  chr8:143606129-143606159
  Hypo

SEQ ID NO: 130261 - DNA, 35 bp, Homo sapiens; identical to SEQ ID NO: 98943
  chr8:143609580-143609615
  Hypo

SEQ ID NO: 130262 - DNA, 67 bp, Homo sapiens; identical to SEQ ID NO: 98944
  chr8:143616161-143616228
  Hypo

SEQ ID NO: 130263 - DNA, 47 bp, Homo sapiens; identical to SEQ ID NO: 42038
  chr8:143618365-143618412
  Hypo

SEQ ID NO: 130264 - DNA, 88 bp, Homo sapiens; identical to SEQ ID NO: 98946
  chr8:143620736-143620824
  Hypo

SEQ ID NO: 130265 - DNA, 161 bp, Homo sapiens; identical to SEQ ID NO: 15189
  chr8:143621956-143622117
  Hypo

SEQ ID NO: 130266 - DNA, 541 bp, Homo sapiens; identical to SEQ ID NO: 98948
  chr8:143623394-143623935
  Hypo

SEQ ID NO: 130267 - DNA, 30 bp, Homo sapiens; identical to SEQ ID NO: 42043
  chr8:143624997-143625027
  Hypo

SEQ ID NO: 130268 - DNA, 34 bp, Homo sapiens; identical to SEQ ID NO: 42044
  chr8:143631480-143631514
  Hypo

SEQ ID NO: 130269 - DNA, 45 bp, Homo sapiens; identical to SEQ ID NO: 98951
  chr8:143652467-143652512
  Hypo

SEQ ID NO: 130270 - DNA, 95 bp, Homo sapiens; identical to SEQ ID NO: 98952
  chr8:143656193-143656288
  Hypo

SEQ ID NO: 130271 - DNA, 37 bp, Homo sapiens; identical to SEQ ID NO: 98953
  chr8:143660632-143660669
  Hypo

SEQ ID NO: 130272 - DNA, 40 bp, Homo sapiens; identical to SEQ ID NO: 98954
  chr8:143665380-143665420
  Hypo

SEQ ID NO: 130273 - DNA, 33 bp, Homo sapiens; identical to SEQ ID NO: 98955
  chr8:143665824-143665857
  Hypo

SEQ ID NO: 130274 - DNA, 30 bp, Homo sapiens; identical to SEQ ID NO: 98956
  chr8:143671868-143671898
  Hypo

SEQ ID NO: 130275 - DNA, 30 bp, Homo sapiens; identical to SEQ ID NO: 98957
  chr8:143677149-143677179
  Hypo

SEQ ID NO: 130276 - DNA, 30 bp, Homo sapiens; identical to SEQ ID NO: 98958
  chr8:143679642-143679672
  Hypo

SEQ ID NO: 130277 - DNA, 353 bp, Homo sapiens; identical to SEQ ID NO: 98959
  chr8:143695463-143695816
  Hyper

SEQ ID NO: 130278 - DNA, 30 bp, Homo sapiens; identical to SEQ ID NO: 42046
  chr8:143702052-143702082
  Hypo

SEQ ID NO: 130279 - DNA, 30 bp, Homo sapiens; identical to SEQ ID NO: 98961
  chr8:143704046-143704076
  Hypo

SEQ ID NO: 130280 - DNA, 30 bp, Homo sapiens; identical to SEQ ID NO: 98962
  chr8:143704780-143704810
  Hypo

SEQ ID NO: 130281 - DNA, 136 bp, Homo sapiens; identical to SEQ ID NO: 98963
  chr8:143819384-143819520
  Hypo

SEQ ID NO: 130282 - DNA, 30 bp, Homo sapiens; identical to SEQ ID NO: 42048
  chr8:143827179-143827209
  Hypo

SEQ ID NO: 130283 - DNA, 45 bp, Homo sapiens; identical to SEQ ID NO: 98965
  chr8:143831792-143831837
  Hypo

SEQ ID NO: 130284 - DNA, 61 bp, Homo sapiens; identical to SEQ ID NO: 42049
  chr8:143833212-143833273
  Hypo

SEQ ID NO: 130285 - DNA, 30 bp, Homo sapiens; identical to SEQ ID NO: 98967
  chr8:143840647-143840677
  Hypo

SEQ ID NO: 130286 - DNA, 30 bp, Homo sapiens; identical to SEQ ID NO: 98969
  chr8:143855362-143855392
  Hypo

SEQ ID NO: 130287 - DNA, 159 bp, Homo sapiens; identical to SEQ ID NO: 98970
  chr8:143855667-143855826
  Hypo

SEQ ID NO: 130288 - DNA, 30 bp, Homo sapiens; identical to SEQ ID NO: 98971
  chr8:143857179-143857209
  Hypo

SEQ ID NO: 130289 - DNA, 217 bp, Homo sapiens; identical to SEQ ID NO: 98972
  chr8:143858535-143858752
  Hyper

SEQ ID NO: 130290 - DNA, 234 bp, Homo sapiens
  chr8:143859127-143859361
  Hyper
acacagaggcagccacgcagtgattccctggcgaccctcagactcacgtgttcagcccggacactccgcaggctatcttcaccgcgtcccgcggcagcccagccttccccgcagccgcctccgcccactcgcccgcgccgcgtcgtttgtcggccggcaccagccttgcggccccagctccgccctcctgcagcccaggcccagcagctccggaactggcgccctttggcgcac

SEQ ID NO: 130291 - DNA, 124 bp, Homo sapiens; identical to SEQ ID NO: 98975
  chr8:143870853-143870977
  Hypo

SEQ ID NO: 130292 - DNA, 74 bp, Homo sapiens; identical to SEQ ID NO: 98976
  chr8:143876922-143876996
  Hypo

SEQ ID NO: 130293 - DNA, 33 bp, Homo sapiens; identical to SEQ ID NO: 42052
  chr8:143879185-143879218
  Hypo

SEQ ID NO: 130294 - DNA, 182 bp, Homo sapiens; identical to SEQ ID NO: 98978
  chr8:143882149-143882331
  Hypo

SEQ ID NO: 130295 - DNA, 30 bp, Homo sapiens; identical to SEQ ID NO: 98979
  chr8:143921405-143921435
  Hypo

SEQ ID NO: 130296 - DNA, 123 bp, Homo sapiens; identical to SEQ ID NO: 98980
  chr8:143956397-143956520
  Hypo

SEQ ID NO: 130297 - DNA, 129 bp, Homo sapiens; identical to SEQ ID NO: 98981
  chr8:143956795-143956924
  Hypo

SEQ ID NO: 130298 - DNA, 173 bp, Homo sapiens; identical to SEQ ID NO: 98982
  chr8:143960027-143960200
  Hypo

SEQ ID NO: 130299 - DNA, 247 bp, Homo sapiens; identical to SEQ ID NO: 98983
  chr8:143993967-143994214
  Hypo

SEQ ID NO: 130300 - DNA, 33 bp, Homo sapiens; identical to SEQ ID NO: 98984
  chr8:143994764-143994797
  Hypo

SEQ ID NO: 130301 - DNA, 159 bp, Homo sapiens; identical to SEQ ID NO: 98985
  chr8:143996499-143996658
  Hypo

SEQ ID NO: 130302 - DNA, 32 bp, Homo sapiens; identical to SEQ ID NO: 98986
  chr8:143998295-143998327
  Hypo

SEQ ID NO: 130303 - DNA, 33 bp, Homo sapiens; identical to SEQ ID NO: 42057
  chr8:144015246-144015279
  Hypo

SEQ ID NO: 130304 - DNA, 175 bp, Homo sapiens; identical to SEQ ID NO: 98988
  chr8:144027680-144027855
  Hypo

SEQ ID NO: 130305 - DNA, 119 bp, Homo sapiens; identical to SEQ ID NO: 98989
  chr8:144058296-144058415
  Hypo

SEQ ID NO: 130306 - DNA, 119 bp, Homo sapiens; identical to SEQ ID NO: 98990
  chr8:144069546-144069665
  Hypo

SEQ ID NO: 130307 - DNA, 151 bp, Homo sapiens; identical to SEQ ID NO: 42060
  chr8:144070508-144070659
  Hypo

SEQ ID NO: 130308 - DNA, 61 bp, Homo sapiens; identical to SEQ ID NO: 98992
  chr8:144090641-144090702
  Hypo

SEQ ID NO: 130309 - DNA, 143 bp, Homo sapiens; identical to SEQ ID NO: 98993
  chr8:144099550-144099693
  Hyper

SEQ ID NO: 130310 - DNA, 128 bp, Homo sapiens; identical to SEQ ID NO: 42062
  chr8:144164496-144164624
  Hypo

SEQ ID NO: 130311 - DNA, 186 bp, Homo sapiens; identical to SEQ ID NO: 98995
  chr8:144190312-144190498
  Hypo

SEQ ID NO: 130312 - DNA, 264 bp, Homo sapiens; identical to SEQ ID NO: 98996
  chr8:144203678-144203942
  Hypo

SEQ ID NO: 130313 - DNA, 30 bp, Homo sapiens; identical to SEQ ID NO: 98997
  chr8:144204525-144204555
  Hypo

SEQ ID NO: 130314 - DNA, 134 bp, Homo sapiens; identical to SEQ ID NO: 98998
  chr8:144208693-144208827
  Hypo

SEQ ID NO: 130315 - DNA, 42 bp, Homo sapiens; identical to SEQ ID NO: 98999
  chr8:144209468-144209510
  Hypo

SEQ ID NO: 130316 - DNA, 61 bp, Homo sapiens; identical to SEQ ID NO: 99000
  chr8:144216486-144216547
  Hypo

SEQ ID NO: 130317 - DNA, 42 bp, Homo sapiens; identical to SEQ ID NO: 99001
  chr8:144222920-144222962
  Hypo

SEQ ID NO: 130318 - DNA, 218 bp, Homo sapiens; identical to SEQ ID NO: 99002
  chr8:144226037-144226255
  Hypo

SEQ ID NO: 130319 - DNA, 41 bp, Homo sapiens; identical to SEQ ID NO: 99003
  chr8:144236655-144236696
  Hypo

SEQ ID NO: 130320 - DNA, 249 bp, Homo sapiens; identical to SEQ ID NO: 99004
  chr8:144238806-144239055
  Hypo

SEQ ID NO: 130321 - DNA, 1104 bp, Homo sapiens
  chr8:144241199-144242303
  Hyper
cccggaatccaaggccggggtccgcccggagctcgcagagccccacccccagccccttctccagagcgtccgccgtcacagcatccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggcgggagcgggtgggacctgccactggggggaggggcgcgtgccaggtccccacccccacccctgggctggggggccgggaaccccgggccgagtcccctcccttggccttccgcgcgcgcctcggcgctcaccgcggatggggcgtggagcgcgggcctcggggtcggggggctcactcacatcccgggggtgtccgcactccgggctcgggcggcgtgcgcggcgcggggagctgtgcccttcggtctccctgcggaccggaatccgggcgcagcctcgtctttcggggaacgcagccgcagacgcggaccccgcgcgaggggcggggcggagccggggcgggggccgcgcggggggcgggggcggctgggagacgcgcggggcggggggcgcccggggctcgcggcccccacgcaggtagctggcccgggccctccgcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcctccccgcccctccccaacctcatacccgtttccccgtttccccgtttccagtggctccaggccgttctcctcccctgagcatccatgaagacccccaccagaagccgcagccccaggggcttctgtcgccaaatactccca

SEQ ID NO: 130322 - DNA, 30 bp, Homo sapiens; identical to SEQ ID NO: 99009
  chr8:144275059-144275089
  Hypo

SEQ ID NO: 130323 - DNA, 104 bp, Homo sapiens; identical to SEQ ID NO: 99010
  chr8:144291486-144291590
  Hypo

SEQ ID NO: 130324 - DNA, 125 bp, Homo sapiens; identical to SEQ ID NO: 99011
  chr8:144292345-144292470
  Hypo

SEQ ID NO: 130325 - DNA, 317 bp, Homo sapiens; identical to SEQ ID NO: 99012
  chr8:144293576-144293893
  Hypo

SEQ ID NO: 130326 - DNA, 39 bp, Homo sapiens; identical to SEQ ID NO: 99013
  chr8:144303553-144303592
  Hypo

SEQ ID NO: 130327 - DNA, 147 bp, Homo sapiens; identical to SEQ ID NO: 42070
  chr8:144312859-144313006
  Hypo

SEQ ID NO: 130328 - DNA, 30 bp, Homo sapiens; identical to SEQ ID NO: 99015
  chr8:144322593-144322623
  Hypo

SEQ ID NO: 130329 - DNA, 214 bp, Homo sapiens; identical to SEQ ID NO: 42071
  chr8:144326825-144327039
  Hypo

SEQ ID NO: 130330 - DNA, 434 bp, Homo sapiens; identical to SEQ ID NO: 99017
  chr8:144328173-144328607
  Hyper

SEQ ID NO: 130331 - DNA, 149 bp, Homo sapiens; identical to SEQ ID NO: 42072
  chr8:144330269-144330418
  Hypo

SEQ ID NO: 130332 - DNA, 511 bp, Homo sapiens; identical to SEQ ID NO: 42073
  chr8:144343481-144343992
  Hypo

SEQ ID NO: 130333 - DNA, 519 bp, Homo sapiens; identical to SEQ ID NO: 99020
  chr8:144344219-144344738
  Hypo

SEQ ID NO: 130334 - DNA, 37 bp, Homo sapiens; identical to SEQ ID NO: 99021
  chr8:144347022-144347059
  Hypo

SEQ ID NO: 130335 - DNA, 30 bp, Homo sapiens; identical to SEQ ID NO: 99022
  chr8:144350950-144350980
  Hypo

SEQ ID NO: 130336 - DNA, 516 bp, Homo sapiens; identical to SEQ ID NO: 99023
  chr8:144360029-144360545
  Hypo

SEQ ID NO: 130337 - DNA, 203 bp, Homo sapiens; identical to SEQ ID NO: 99024
  chr8:144361658-144361861
  Hypo

SEQ ID NO: 130338 - DNA, 15 bp, Homo sapiens
  chr8:144371132-144371147
  Hypo
cggcctggactcggc

SEQ ID NO: 130339 - DNA, 40 bp, Homo sapiens; identical to SEQ ID NO: 99027
  chr8:144372463-144372503
  Hypo

SEQ ID NO: 130340 - DNA, 30 bp, Homo sapiens; identical to SEQ ID NO: 99028
  chr8:144380615-144380645
  Hypo

SEQ ID NO: 130341 - DNA, 92 bp, Homo sapiens; identical to SEQ ID NO: 99029
  chr8:144383315-144383407
  Hypo

SEQ ID NO: 130342 - DNA, 35 bp, Homo sapiens; identical to SEQ ID NO: 42080
  chr8:144386583-144386618
  Hypo

SEQ ID NO: 130343 - DNA, 30 bp, Homo sapiens; identical to SEQ ID NO: 99031
  chr8:144400398-144400428
  Hypo

SEQ ID NO: 130344 - DNA, 30 bp, Homo sapiens; identical to SEQ ID NO: 99032
  chr8:144413752-144413782
  Hypo

SEQ ID NO: 130345 - DNA, 35 bp, Homo sapiens; identical to SEQ ID NO: 99033
  chr8:144414248-144414283
  Hypo

SEQ ID NO: 130346 - DNA, 30 bp, Homo sapiens; identical to SEQ ID NO: 42081
  chr8:144452062-144452092
  Hypo

SEQ ID NO: 130347 - DNA, 99 bp, Homo sapiens; identical to SEQ ID NO: 99035
  chr8:144457736-144457835
  Hypo

SEQ ID NO: 130348 - DNA, 30 bp, Homo sapiens; identical to SEQ ID NO: 99036
  chr8:144462244-144462274
  Hypo

SEQ ID NO: 130349 - DNA, 30 bp, Homo sapiens; identical to SEQ ID NO: 99037
  chr8:144463829-144463859
  Hypo

SEQ ID NO: 130350 - DNA, 30 bp, Homo sapiens; identical to SEQ ID NO: 99038
  chr8:144469769-144469799
  Hypo

SEQ ID NO: 130351 - DNA, 30 bp, Homo sapiens; identical to SEQ ID NO: 99039
  chr8:144470566-144470596
  Hypo

SEQ ID NO: 130352 - DNA, 210 bp, Homo sapiens; identical to SEQ ID NO: 99040
  chr8:144471625-144471835
  Hypo

SEQ ID NO: 130353 - DNA, 30 bp, Homo sapiens; identical to SEQ ID NO: 99041
  chr8:144474879-144474909
  Hypo

SEQ ID NO: 130354 - DNA, 502 bp, Homo sapiens; identical to SEQ ID NO: 99042
  chr8:144489693-144490195
  Hyper

SEQ ID NO: 130355 - DNA, 346 bp, Homo sapiens; identical to SEQ ID NO: 99043
  chr8:144503380-144503726
  Hyper

SEQ ID NO: 130356 - DNA, 30 bp, Homo sapiens; identical to SEQ ID NO: 99044
  chr8:144508721-144508751
  Hyper

SEQ ID NO: 130357 - DNA, 3353 bp, Homo sapiens; identical to SEQ ID NO: 99045
  chr8:144509019-144512372
  Hyper

SEQ ID NO: 130358 - DNA, 30 bp, Homo sapiens; identical to SEQ ID NO: 99046
  chr8:144516420-144516450
  Hypo

SEQ ID NO: 130359 - DNA, 30 bp, Homo sapiens; identical to SEQ ID NO: 99047
  chr8:144519943-144519973
  Hypo

SEQ ID NO: 130360 - DNA, 142 bp, Homo sapiens; identical to SEQ ID NO: 99048
  chr8:144521622-144521764
  Hypo

SEQ ID NO: 130361 - DNA, 30 bp, Homo sapiens; identical to SEQ ID NO: 99049
  chr8:144523644-144523674
  Hypo

SEQ ID NO: 130362 - DNA, 77 bp, Homo sapiens; identical to SEQ ID NO: 99050
  chr8:144552565-144552642
  Hypo

SEQ ID NO: 130363 - DNA, 241 bp, Homo sapiens; identical to SEQ ID NO: 99051
  chr8:144573164-144573405
  Hypo

SEQ ID NO: 130364 - DNA, 105 bp, Homo sapiens; identical to SEQ ID NO: 99052
  chr8:144589977-144590082
  Hypo

SEQ ID NO: 130365 - DNA, 98 bp, Homo sapiens; identical to SEQ ID NO: 99053
  chr8:144591105-144591203
  Hypo

SEQ ID NO: 130366 - DNA, 137 bp, Homo sapiens; identical to SEQ ID NO: 99054
  chr8:144636432-144636569
  Hypo

SEQ ID NO: 130367 - DNA, 197 bp, Homo sapiens; identical to SEQ ID NO: 99055
  chr8:144636689-144636886
  Hypo

SEQ ID NO: 130368 - DNA, 261 bp, Homo sapiens; identical to SEQ ID NO: 99056
  chr8:144650869-144651130
  Hyper

SEQ ID NO: 130369 - DNA, 405 bp, Homo sapiens
  chr8:144651594-144651999
  Hyper
cggggcgtttgctcacgtcgtccagtagcggagggaggcgcggtcccagctccgcgctcaggagccgcacaggcgcccggggccgcagcaggagcctcctcagggcgcccagcgctgcacccacgagccgcgcgtcgccttcgcccagtgcgcccaggagcgccggcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacctcctcccgcaggagccgtgcggtgggccgg

SEQ ID NO: 130370 - DNA, 199 bp, Homo sapiens; identical to SEQ ID NO: 99059
  chr8:144653759-144653958
  Hyper

SEQ ID NO: 130371 - DNA, 175 bp, Homo sapiens; identical to SEQ ID NO: 42087
  chr8:144656770-144656945
  Hypo

SEQ ID NO: 130372 - DNA, 83 bp, Homo sapiens; identical to SEQ ID NO: 99061
  chr8:144658208-144658291
  Hypo

SEQ ID NO: 130373 - DNA, 30 bp, Homo sapiens; identical to SEQ ID NO: 99062
  chr8:144661901-144661931
  Hypo

SEQ ID NO: 130374 - DNA, 378 bp, Homo sapiens; identical to SEQ ID NO: 99063
  chr8:144668612-144668990
  Hypo

SEQ ID NO: 130375 - DNA, 119 bp, Homo sapiens; identical to SEQ ID NO: 99064
  chr8:144675999-144676118
  Hypo

SEQ ID NO: 130376 - DNA, 191 bp, Homo sapiens; identical to SEQ ID NO: 99065
  chr8:144677837-144678028
  Hypo

SEQ ID NO: 130377 - DNA, 231 bp, Homo sapiens; identical to SEQ ID NO: 99066
  chr8:144681590-144681821
  Hypo

SEQ ID NO: 130378 - DNA, 30 bp, Homo sapiens; identical to SEQ ID NO: 99067
  chr8:144682361-144682391
  Hypo

SEQ ID NO: 130379 - DNA, 126 bp, Homo sapiens; identical to SEQ ID NO: 99068
  chr8:144683678-144683804
  Hypo

SEQ ID NO: 130380 - DNA, 122 bp, Homo sapiens; identical to SEQ ID NO: 42092
  chr8:144685577-144685699
  Hypo

SEQ ID NO: 130381 - DNA, 30 bp, Homo sapiens; identical to SEQ ID NO: 99070
  chr8:144688031-144688061
  Hypo

SEQ ID NO: 130382 - DNA, 80 bp, Homo sapiens; identical to SEQ ID NO: 99071
  chr8:145236678-145236758
  Hypo

SEQ ID NO: 130383 - DNA, 30 bp, Homo sapiens; identical to SEQ ID NO: 99072
  chr8:145697556-145697586
  Hypo

SEQ ID NO: 130384 - DNA, 641 bp, Homo sapiens
  chr8:145697791-145698432
  Hyper
cccagaaggccagggcgggatccaggtggctggcctcacccactgggacgtgcccaacctggagacattgcaccaggtagggctgcaccgctctccgagaccccgccccgtgcttccacttgggggcggggaccctgcacctgaccagcccttcgccccgccttccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgc

SEQ ID NO: 130385 - DNA, 30 bp, Homo sapiens
  chr8:145698644-145698674
  Hyper
tcagcaccgacactccgctcaccgggaccc

SEQ ID NO: 130386 - DNA, 578 bp, Homo sapiens; identical to SEQ ID NO: 99075
  chr8:145700223-145700801
  Hyper

SEQ ID NO: 130387 - DNA, 30 bp, Homo sapiens; identical to SEQ ID NO: 99076
  chr8:145702531-145702561
  Hypo

SEQ ID NO: 130388 - DNA, 168 bp, Homo sapiens; identical to SEQ ID NO: 99077
  chr8:145728372-145728540
  Hypo

SEQ ID NO: 130389 - DNA, 185 bp, Homo sapiens; identical to SEQ ID NO: 42093
  chr8:145739768-145739953
  Hypo

SEQ ID NO: 130390 - DNA, 86 bp, Homo sapiens; identical to SEQ ID NO: 99079
  chr8:145745121-145745207
  Hypo

SEQ ID NO: 130391 - DNA, 30 bp, Homo sapiens; identical to SEQ ID NO: 99080
  chr8:145751684-145751714
  Hypo

SEQ ID NO: 130392 - DNA, 30 bp, Homo sapiens; identical to SEQ ID NO: 99081
  chr8:145751965-145751995
  Hypo

SEQ ID NO: 130393 - DNA, 521 bp, Homo sapiens; identical to SEQ ID NO: 99082
  chr8:145753251-145753772
  Hypo

SEQ ID NO: 130394 - DNA, 30 bp, Homo sapiens; identical to SEQ ID NO: 99083
  chr8:145755230-145755260
  Hyper

SEQ ID NO: 130395 - DNA, 166 bp, Homo sapiens; identical to SEQ ID NO: 99084
  chr8:145758526-145758692
  Hypo

SEQ ID NO: 130396 - DNA, 87 bp, Homo sapiens
  chr8:145806186-145806273
  Hyper
ccattcacctggccccgcccatagcagctgcccccgccctcacctgccgctgtcctccttcactgtcccaaacgccgcgggccgccc

SEQ ID NO: 130397 - DNA, 30 bp, Homo sapiens
  chr8:145806596-145806626
  Hyper
cggtgaccaggttggcgtacatgcgctcgc

SEQ ID NO: 130398 - DNA, 18 bp, Homo sapiens
  chr8:145919061-145919079
  Hypo
ggccgtaaaattctttga

SEQ ID NO: 130399 - DNA, 424 bp, Homo sapiens
  chr8:145925298-145925722
  Hyper
acagaactctttctccgtgaatcgcatccttttctgtgcgggatgatttacattctgggaacaaacggggccgtatctcacagtgctgcaggatgccagtggtgcaaacagtcggcgacccggccatttcccgagggtctcaggcgtcccacccaacggccgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctgagggagccaggcgggagagaggggaaccaccgaggcctcggtcttcccgcgtcccagagcggccgggcgagtctcact

SEQ ID NO: 130400 - DNA, 43 bp, Homo sapiens; identical to SEQ ID NO: 99090
  chr8:145925938-145925981
  Hyper

SEQ ID NO: 130401 - DNA, 36 bp, Homo sapiens
  chr8:145938903-145938939
  Hyper
cgtggggaggggccacgtccccgctgccccagccag

SEQ ID NO: 130402 - DNA, 192 bp, Homo sapiens; identical to SEQ ID NO: 42098
  chr8:145979452-145979644
  Hypo

SEQ ID NO: 130403 - DNA, 136 bp, Homo sapiens; identical to SEQ ID NO: 99092
  chr8:146013511-146013647
  Hypo

SEQ ID NO: 130404 - DNA, 30 bp, Homo sapiens; identical to SEQ ID NO: 99093
  chr8:146015447-146015477
  Hypo

SEQ ID NO: 130405 - DNA, 34 bp, Homo sapiens; identical to SEQ ID NO: 99094
  chr8:146036285-146036319
  Hypo

SEQ ID NO: 130406 - DNA, 30 bp, Homo sapiens; identical to SEQ ID NO: 42100
  chr8:146050247-146050277
  Hypo

SEQ ID NO: 130407 - DNA, 34 bp, Homo sapiens; identical to SEQ ID NO: 99096
  chr8:146055565-146055599
  Hypo

SEQ ID NO: 130408 - DNA, 98 bp, Homo sapiens; identical to SEQ ID NO: 5087
  chr8:146079215-146079313
  Hypo

SEQ ID NO: 130409 - DNA, 278 bp, Homo sapiens; identical to SEQ ID NO: 101179
  chr9:73219-73497
  Hyper

SEQ ID NO: 130410 - DNA, 935 bp, Homo sapiens
  chr9:113392-114327
  Hyper
cgccccttggaccttcgccccaggccggcgcagcccagcttcccgggcaggctccacgctaccggggtccagtgcgcggcgacgaagcggagagctgtgtccagactccggagagaaactccggctccgcggggcggcgcggggcggcgcggggcccggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggctt

SEQ ID NO: 130411 - DNA, 213 bp, Homo sapiens; identical to SEQ ID NO: 100186
  chr9:114717-114930
  Hyper

SEQ ID NO: 130412 - DNA, 264 bp, Homo sapiens
  chr9:117872-118136
  Hyper
caaactctgaggggtcgctcgggccgccgccgccctcgatgtgctctcggggaagcgcaaccccgccccaccgggccacctgcagccccggctggagcgactgctctaggaactgctggctcgccgcctcctcctcgtcttcatcttcctcctctcccaggacatcgattttaccgtcttccccatcggagtcccggaggctgcgctgcggtgtggagcgaaggcgctcagctcttggcaagttcatggcggagcaggtgcttc

SEQ ID NO: 130413 - DNA, 697 bp, Homo sapiens; identical to SEQ ID NO: 100975
  chr9:214651-215348
  Hyper

SEQ ID NO: 130414 - DNA, 24 bp, Homo sapiens
  chr9:258867-258891
  Hypo
gattacgggcgtgagccaccatat

SEQ ID NO: 130415 - DNA, 101 bp, Homo sapiens; identical to SEQ ID NO: 101024
  chr9:284463-284564
  Hypo

SEQ ID NO: 130416 - DNA, 30 bp, Homo sapiens; identical to SEQ ID NO: 101085
  chr9:360368-360398
  Hypo

SEQ ID NO: 130417 - DNA, 30 bp, Homo sapiens; identical to SEQ ID NO: 101119
  chr9:377164-377194
  Hypo

SEQ ID NO: 130418 - DNA, 30 bp, Homo sapiens; identical to SEQ ID NO: 101133
  chr9:415015-415045
  Hypo

SEQ ID NO: 130419 - DNA, 35 bp, Homo sapiens; identical to SEQ ID NO: 101140
  chr9:505604-505639
  Hyper

SEQ ID NO: 130420 - DNA, 30 bp, Homo sapiens; identical to SEQ ID NO: 101143
  chr9:592406-592436
  Hypo

SEQ ID NO: 130421 - DNA, 877 bp, Homo sapiens
  chr9:841367-842244
  Hyper
gcttcctcggtgcaccgtgctttggcaaccgggtcttggcgcctccgagagcggggcgaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttt

SEQ ID NO: 130422 - DNA, 1176 bp, Homo sapiens
  chr9:842544-843720
  Hyper
tttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgc

SEQ ID NO: 130423 - DNA, 1638 bp, Homo sapiens
  chr9:969556-971194
  Hyper
ctgtagctgttgtgacggctacggcggaggctgcggccgcgcggggaatggagccggaccgcggagtcgtcacctccaaggtgtttctagtggcctcctggaagatgatcccgcgcccaccttgccggcgtgttcgcgggcccctgcccactgccccccctctttctttaggtctggcttttgaggatcccggagtcttgcagctcccgccattccgcagataacctccgcacacttaattgtgacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttctaaacccaccggcctcgcctaacgccgtttggtgctgcatccgagcggcctcacgcggtcccctggaagggccactcccagcgggagggcggggcccgggacctgcgctggccacgcagggtctcaagctgaccggaagacccggcttttggcctgtgtccaatagccccagaagagaggggtctggagccttcctcccacgcgtagtgacgctcaggtgtcctcgggttgttagtcttgacccaggagagtgcaagacaggcccaaggcctggggggattgcgttatgaatgtccaattctaaacacaaggtagagcacagacagtacatcctcacggctggattttaaccgtattttaataaacacattcgagggggtgtcagtttccccaagctctgcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttggctcaaatttcacctcgagtcctgcagaccctgcgccactgaattggggcccaggacgcccttggtgacactcgccttcttgctgccacaaccaccgtcatacccgcagccggggctccctccgctaaccacgcttggagaccccaatcggggacagaggtgggagtcagaccccccctggcctgcactgccgtttccctcgattcttgcggaaacaagactcccgcccacacataaaaatgcagctcccggccaccgggcgccggtggctcacgcctgtaatcccaacaccttggg

SEQ ID NO: 130424 - DNA, 138 bp, Homo sapiens
  chr9:971434-971572
  Hyper
aaaatatgcagccccctccgctccacttgaactttaatgctgaaccggtttcccacgtatacgtgtatcgcaccgcattttgacgctttgcatcgagtcgcattaatggcgcttttgagaacgcgtcgtcgcgcttta

SEQ ID NO: 130425 - DNA, 1437 bp, Homo sapiens
  chr9:971852-973289
  Hyper
tacccctcccccacccgcctgccctcgggagcgggtcgcctccactccaccacctgtttaagttcctccccctcggcgcccctccagtccccaccccggccccggtccaaaaaaccagcaaacggaacttttccacagttgaaagccgcggcccgcgaggccgggctgggaggggaaagcggggcgtgtctggggggcggggccccgagcactccggaagttgccccgcccaggaggctcctgggaaagtgaggagagggcccgggcctactttcgtcctggtgtggcgcccctcagcctcccctcctcccagttcccgcgcctccgcagggcgcctcggcctggcctccaggcaaagttcgcgccccctgttcctggggtgtcggccgcgcgggccgtttcccttcattactcccgggcccctgaatccgaacgctttcccagaagcgcgcaaatccgcttgctttccccgcggctgggctttgttcagggacagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccagggcctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcccggtcggcttagggccagcgaggtcacaggccgttctgctctccctgtttgtccccaaaggcctcggcacgtggggatctggagcaggcctcaggctgcgacccgtctcttcccctaccaaaattatgtgggaacagcggtccaggaccttcccctgttcagcggtatccccgggccggtgaccccggggttcagtcgtctccccgaccccaagcggcctctgctttccacccctcgccccggagggcggcttcggggatctcatggg

SEQ ID NO: 130426 - DNA, 43 bp, Homo sapiens; identical to SEQ ID NO: 32349
  chr9:973762-973805
  Hyper

SEQ ID NO: 130427 - DNA, 1628 bp, Homo sapiens
  chr9:975333-976961
  Hyper
cagcggacttgcctacgctctcatctagcatttgattccccaccaggagatgggcttggtgcacgctctcagaagcgcatccaccgaaggctctggaactgccccgcttcgcatagagctattgtgctgccctgcagtgtatccacttgttttgtttgtttgtttgttttttggtttttgcttgtttgctgatgggcagtggggaggtgcgagggtggagggccttctttgtgcatatatagcgatagtctgcactaggccaagcccgctactcctgggagaatgggaacacgcaaataatctaaacaaagttttctgctgtcatcttgtgaaggaccctctcccccaagacatctatgactggggtctatgggttaaggaggtgaaaaagtggccccatcccatatccataactgaatcacagaatccgtggggatttgaactgagtggctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtcgccggctccttgcagccgccgcagcgcctccgcgaaggaggacgtgccgacccggctgcgcgcccaaggcagaggcccgcgtcggcgttggctgggcgtgagctgggaggccgagctgtgagcgcgaagggagctggagagacgactgcggcacctccggccgccccggagcacacacgaccaccggggctgcgggaccaagggccgcgtcgcccggaggccgcccctgagcgggcctcgcagccccgccgtccagcgctccctggccctc

SEQ ID NO: 130428 - DNA, 432 bp, Homo sapiens; identical to SEQ ID NO: 101388
  chr9:977171-977603
  Hyper

SEQ ID NO: 130429 - DNA, 287 bp, Homo sapiens; identical to SEQ ID NO: 101400
  chr9:981609-981896
  Hyper

SEQ ID NO: 130430 - DNA, 660 bp, Homo sapiens
  chr9:1042326-1042986
  Hyper
tggaagggtctgacacggaatctgaccaaggctggaccctcaataattgtgatttcttttcccccttttccttcttggtaaaatcatcccacgaatctacgcaagtagggcccttcgtcattcttcggagtagccgcttgagggctggaaggagcagtgatagaaaccccagagacgcagagaccctccgaacttcgaactcgatcactgtcctcccccgaccgccgaacccgctggagaagcgggcgcgacagggcgatgagttaacgcggagggagcgcggaggccgcggaagccgggggcgctgggtctcaggcccggatgctgagcgcggaccggcgtgtcctccccacagcgcccccgcgcggcctcctcccgctgcgccccgcacggcgacccgccgcgggtagccctggcgtttggccacgccgtcggctgaggaccgctagagctggggggagatcaaagcattcctatggggcccaaagagcctgggattgcagtgttgttagcctggcctcgccgcgtcaataaattttcggcgaaagttgggagcaggagtggaggcttggggcgggggttggtggggcgcgggggttggccggagggagggtccgggggtttcttgcacctgcgctcctgccgcgttaagtcagtggg

SEQ ID NO: 130431 - DNA, 805 bp, Homo sapiens
  chr9:1051513-1052318
  Hyper
agggatggtccctgacggcggccggtgggtctttggatttctttgtgtttccccagagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 130432 - DNA, 143 bp, Homo sapiens; identical to SEQ ID NO: 100978
  chr9:2178015-2178158
  Hypo

SEQ ID NO: 130433 - DNA, 433 bp, Homo sapiens; identical to SEQ ID NO: 101012
  chr9:2621293-2621726
  Hyper

SEQ ID NO: 130434 - DNA, 60 bp, Homo sapiens; identical to SEQ ID NO: 101013
  chr9:2622196-2622256
  Hyper

SEQ ID NO: 130435 - DNA, 80 bp, Homo sapiens; identical to SEQ ID NO: 101014
  chr9:2622942-2623022
  Hyper

SEQ ID NO: 130436 - DNA, 43 bp, Homo sapiens; identical to SEQ ID NO: 101015
  chr9:2623460-2623503
  Hyper

SEQ ID NO: 130437 - DNA, 35 bp, Homo sapiens; identical to SEQ ID NO: 42102
  chr9:2727012-2727047
  Hypo

SEQ ID NO: 130438 - DNA, 30 bp, Homo sapiens; identical to SEQ ID NO: 101029
  chr9:2933843-2933873
  Hypo

SEQ ID NO: 130439 - DNA, 756 bp, Homo sapiens; identical to SEQ ID NO: 101031
  chr9:3181124-3181880
  Hyper

SEQ ID NO: 130440 - DNA, 194 bp, Homo sapiens; identical to SEQ ID NO: 101075
  chr9:3534456-3534650
  Hypo

SEQ ID NO: 130441 - DNA, 50 bp, Homo sapiens; identical to SEQ ID NO: 101134
  chr9:4298596-4298646
  Hyper

SEQ ID NO: 130442 - DNA, 1157 bp, Homo sapiens; identical to SEQ ID NO: 101135
  chr9:4299009-4300166
  Hyper

SEQ ID NO: 130443 - DNA, 30 bp, Homo sapiens; identical to SEQ ID NO: 101139
  chr9:4864629-4864659
  Hypo

SEQ ID NO: 130444 - DNA, 17 bp, Homo sapiens
  chr9:5230606-5230623
  Hypo
caaacctttttgaaacg

SEQ ID NO: 130445 - DNA, 169 bp, Homo sapiens; identical to SEQ ID NO: 101142
  chr9:5864501-5864670
  Hypo

SEQ ID NO: 130446 - DNA, 329 bp, Homo sapiens; identical to SEQ ID NO: 32367
  chr9:6412571-6412900
  Hyper

SEQ ID NO: 130447 - DNA, 257 bp, Homo sapiens
  chr9:6644297-6644554
  Hyper
tgagagcaccctggccggtgagagggtgcctgggaagtggggaatctgctacaaaacgcaggggaagctcgcgggggccctaggataaagaccaagaaccgcacaacaccgactctctcctaacacaaaactgtctgctccgagaaccaaatatcccaccttcccgcggctccggaggtacccgccactgttttattttaatccacacattcccagtcctgagcaatccttaccccagagctcgattttcagggaac

SEQ ID NO: 130448 - DNA, 1305 bp, Homo sapiens; identical to SEQ ID NO: 101147
  chr9:6644869-6646174
  Hyper

SEQ ID NO: 130449 - DNA, 157 bp, Homo sapiens; identical to SEQ ID NO: 101152
  chr9:6704461-6704618
  Hyper

SEQ ID NO: 130450 - DNA, 76 bp, Homo sapiens; identical to SEQ ID NO: 101153
  chr9:6756353-6756429
  Hypo

SEQ ID NO: 130451 - DNA, 76 bp, Homo sapiens; identical to SEQ ID NO: 101154
  chr9:6756729-6756805
  Hypo

SEQ ID NO: 130452 - DNA, 30 bp, Homo sapiens; identical to SEQ ID NO: 15216
  chr9:7164747-7164777
  Hypo

SEQ ID NO: 130453 - DNA, 1247 bp, Homo sapiens
  chr9:8857443-8858690
  Hyper
gagaggacctctgcccgaggaggtccagaggagcaaactgtgcgctccggtgcccgggcgccgggctcgcggaaacgcgagcgtgtcgctctggctcgggaggcgccggcagccggagccgggcgcagggcgattccggagcagcaagaggggaagacaccgcggggcggacggggtcagttccagggactcacctggtcatgttggccccgggcagccgccgccaccgcctcccgcgccgccgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagcccagtccagagcgaggaagtggaagagagtcagcgagtgagtccaaaaacccgaaatccagcatccaaggcagcgcgtccccccgccctccctccacccctacccccttttcctcctcctccgcctcctcctcctcttcccgggccgtcctcttggcccttctgagcccgcggcttccgcggcggtttctcctcctcccgctcctcctgctcgccctgcgcccgcttctctcgctgccgccgccgccgctgtttgtctcctccccctcctcctcctcctcctcttcctcctcctcccgctcctcgatgctccgccgctcgcggctggggggtccggggccgcgtctcctctcctccctccgcctctcctctttcctccttcctgctgcctcttcttttaaagcggattctttggccacaaatagcaactcggctgcccccctcggtgcctccctccccttctcttcttccccccaaaagtgaagcgcacgcgaggtaaccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggc

SEQ ID NO: 130454 - DNA, 170 bp, Homo sapiens; identical to SEQ ID NO: 101372
  chr9:9719642-9719812
  Hypo

SEQ ID NO: 130455 - DNA, 19 bp, Homo sapiens
  chr9:9980357-9980376
  Hypo
caggaattgggaggccgag

SEQ ID NO: 130456 - DNA, 615 bp, Homo sapiens
  chr9:10612684-10613299
  Hyper
tacctgcactctccccgccgaggctggctggcggcgccgcgccggaggggaggaggctcgggaggaggaggagaaagagcagcgggaggactcgggctgggaggggagcgcagggttggggaggccgatgagcggctcccggctcctcggagaagcagccgagacggcaaggaggaggcgaggctctgtcggggcgaggcgctgcccccacgcgctccggccgccggctgcgggcgcggctgggcggggagccgaggcggccgctcccgcactcgctcgctcgctcgctggcgctccctcctcgtctcgctcgcactcacaggcacacaccccacgtctccagcagctgccgctcggcctcacgcactcacctgcatttccttaacgagccacttgatggctgccagcggcgtgggccccgctccggcgggcgggggccggggcggggagaacgcggcgcgggatgctccgagcgcccgctggggagagaagcggcggcggcggcggcgctgcgggcgcgccagatggggcgggaggaggggagacccggcacccaccggcccagagctgcctgacgcggcctgggcggaccccgccgcccgggtgcctaggcac

SEQ ID NO: 130457 - DNA, 18 bp, Homo sapiens
  chr9:11196695-11196713
  Hypo
agtgagaggtgacagcgt

SEQ ID NO: 130458 - DNA, 32 bp, Homo sapiens; identical to SEQ ID NO: 100220
  chr9:11733761-11733793
  Hypo

SEQ ID NO: 130459 - DNA, 162 bp, Homo sapiens; identical to SEQ ID NO: 100321
  chr9:12775664-12775826
  Hyper

SEQ ID NO: 130460 - DNA, 53 bp, Homo sapiens; identical to SEQ ID NO: 100322
  chr9:12776163-12776216
  Hyper

SEQ ID NO: 130461 - DNA, 30 bp, Homo sapiens; identical to SEQ ID NO: 100434
  chr9:13278312-13278342
  Hyper

SEQ ID NO: 130462 - DNA, 221 bp, Homo sapiens; identical to SEQ ID NO: 100435
  chr9:13278735-13278956
  Hyper

SEQ ID NO: 130463 - DNA, 103 bp, Homo sapiens; identical to SEQ ID NO: 100436
  chr9:13279303-13279406
  Hyper

SEQ ID NO: 130464 - DNA, 116 bp, Homo sapiens; identical to SEQ ID NO: 32380
  chr9:13279633-13279749
  Hyper

SEQ ID NO: 130465 - DNA, 70 bp, Homo sapiens; identical to SEQ ID NO: 100554
  chr9:13568991-13569061
  Hyper

SEQ ID NO: 130466 - DNA, 69 bp, Homo sapiens; identical to SEQ ID NO: 100938
  chr9:14313027-14313096
  Hyper

SEQ ID NO: 130467 - DNA, 30 bp, Homo sapiens; identical to SEQ ID NO: 100939
  chr9:14315920-14315950
  Hyper

SEQ ID NO: 130468 - DNA, 248 bp, Homo sapiens; identical to SEQ ID NO: 100940
  chr9:14347425-14347673
  Hyper

SEQ ID NO: 130469 - DNA, 345 bp, Homo sapiens; identical to SEQ ID NO: 3394
  chr9:14348107-14348452
  Hyper

SEQ ID NO: 130470 - DNA, 30 bp, Homo sapiens; identical to SEQ ID NO: 100942
  chr9:14974087-14974117
  Hypo

SEQ ID NO: 130471 - DNA, 17 bp, Homo sapiens
  chr9:15277136-15277153
  Hypo
aatttatgggctgggcg

SEQ ID NO: 130472 - DNA, 27 bp, Homo sapiens
  chr9:15488010-15488037
  Hypo
agaaataaaatttatcggtttaaaagt

SEQ ID NO: 130473 - DNA, 27 bp, Homo sapiens
  chr9:15513969-15513996
  Hypo
tactcaataaaaaagcgccggacgcgg

SEQ ID NO: 130474 - DNA, 29 bp, Homo sapiens
  chr9:15533122-15533151
  Hypo
cccggccagaaagacgtgtttactacaaa

SEQ ID NO: 130475 - DNA, 30 bp, Homo sapiens; identical to SEQ ID NO: 100947
  chr9:16133835-16133865
  Hyper

SEQ ID NO: 130476 - DNA, 105 bp, Homo sapiens
  chr9:16154666-16154771
  Hyper
ctgagcgcagctcctcgccgctcggccatctggcgcgctcccgctccctccacccttctgtcgctcacctggtggagcgcggcccggggacggcagggggcggct

SEQ ID NO: 130477 - DNA, 58 bp, Homo sapiens; identical to SEQ ID NO: 100950
  chr9:16435989-16436047
  Hypo

SEQ ID NO: 130478 - DNA, 33 bp, Homo sapiens; identical to SEQ ID NO: 100951
  chr9:16726995-16727028
  Hyper

SEQ ID NO: 130479 - DNA, 30 bp, Homo sapiens; identical to SEQ ID NO: 100952
  chr9:16727304-16727334
  Hyper

SEQ ID NO: 130480 - DNA, 120 bp, Homo sapiens; identical to SEQ ID NO: 100953
  chr9:16813180-16813300
  Hypo

SEQ ID NO: 130481 - DNA, 349 bp, Homo sapiens; identical to SEQ ID NO: 100954
  chr9:16869976-16870325
  Hyper

SEQ ID NO: 130482 - DNA, 566 bp, Homo sapiens; identical to SEQ ID NO: 100955
  chr9:16870633-16871199
  Hyper

SEQ ID NO: 130483 - DNA, 684 bp, Homo sapiens; identical to SEQ ID NO: 100956
  chr9:16871415-16872099
  Hyper

SEQ ID NO: 130484 - DNA, 30 bp, Homo sapiens; identical to SEQ ID NO: 100957
  chr9:16933048-16933078
  Hypo

SEQ ID NO: 130485 - DNA, 38 bp, Homo sapiens; identical to SEQ ID NO: 100958
  chr9:16964538-16964576
  Hypo

SEQ ID NO: 130486 - DNA, 739 bp, Homo sapiens; identical to SEQ ID NO: 100959
  chr9:17135031-17135770
  Hyper

SEQ ID NO: 130487 - DNA, 1042 bp, Homo sapiens
  chr9:17578706-17579748
  Hyper
gtctttttcaggctgcggcgcagagacgccaggctcaaagggcaggagggccgtctgcaggcagcgccgccgcggctacctggaagcccagcaagtcacctgagtcctgcgggtgcctgggctgccaatctgcagcgacccgtccgcagcccccgggggcaggaacaccaaccccgggacaggaggacgtcctcggcccgctgactagggatccgccagcgggtgccgctgagccacatccccgcagttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcaggtaaggcgcgcggcaggtgcgtcccggggcagtccggggcgaagctgcgaggggcgcgctcggcgctggccgtccggcggcagcttggggagttcggcaccgagcctcgcccgcgccggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggatgtgttggcatgagcggtggccgcactgggggtggcggggcggaggccgg

SEQ ID NO: 130488 - DNA, 668 bp, Homo sapiens
  chr9:17906058-17906726
  Hyper
gaaaagctccatgagcgcccaggggacaagtccccacggacaaacatgtcataacgatttcagttttgtcccattacgtgaggttgtaagtttcttcatcattcccccctcccaacaagcacaaaatcgtccccagcccctggagcatcttgcggggctcccaggtcagcaacagcactcggagctccgagctccagggaaagcgctcagggaatggctcctaggactggttcctgggaaagcgccagcgtccagggagagatttccttctccaagggccggcagggtggcattccaagcgcgagcaaggtgggcagtgagcgatcctccctttaaaaaagaataaataaatagaagccagcgcgcagccccgctcgggtttcccgaagcgcacaccgctgtcgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctccaaagccgcgccgcctgccccagcgcagctctgtctcgtggggcgcacgcccgagccc

SEQ ID NO: 130489 - DNA, 578 bp, Homo sapiens
  chr9:17906983-17907561
  Hyper
cgaaaagcgctacagcgtgggaggtgctctcttccgcgaaggtccatcctggggctgcgctgccgcccaggctggggacaagtggcgcggggttggggctaaggcgtaccctggggtcgatcgggtcgatctctgcgtttaggcttgacccagcttcctgggaccctgtcctggcttttcgcccttacctgggtcctgcttccagccaggcagagccggggcgagaaggcggcgcctgagctggggagctgtcatccccaacagtcctctaccccccaccctttccgacagtccttcgcggagccccctctctcgttccaggctgaggcttgggcggcgccggggacactcgggtgctgggacactcctccacacttccgcccttctgcggacctagtgaacttctgacactgtcaccctagggccgcccgcagccgagtgtcgggggcgcagcgttgtaatgtgtgcggacgccggaccaggtgggctccctggtgcctccgcggtctagaggtggctctggtgggtgggtgcccgaggattggccctgaccataccccctccgaatcctcccaggg

SEQ ID NO: 130490 - DNA, 273 bp, Homo sapiens
  chr9:19127231-19127504
  Hyper
ccaggacctggaagccgcgaggcgagcggggggtctcggaccatcacccccgcgtcccgtccacctttgagccccgcggggagcagagcagcggtcccaaggccccggggagccccccaccccaactgggcgccgctgggggcccgggaccggttcgctggggcacccactgggcgcgcactcaccgacggactgcagcgaaaggcgaagagcaggcgcgtcccgaagacgactccggctgccacgacccggtcaaagcgtggggcccgcggg

SEQ ID NO: 130491 - DNA, 30 bp, Homo sapiens; identical to SEQ ID NO: 100967
  chr9:19374806-19374836
  Hypo

SEQ ID NO: 130492 - DNA, 30 bp, Homo sapiens; identical to SEQ ID NO: 100968
  chr9:19780077-19780107
  Hypo

SEQ ID NO: 130493 - DNA, 1101 bp, Homo sapiens
  chr9:19788200-19789301
  Hyper
actcctgagataacccgaccccatcacggagattcccaggtggctgcgaacgtcaacgcttagcaggaacgattaagcgattcacagcactcaggggattgtgtaaatgcccggcccgggcgaccagcagggacagattcaactccccgggcgcaaagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacgcgcacacggcggggcccccgagcgcggcccgccgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgcgctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagagaggagaaatcgtacaggtcggtgacgcgcctaattcacaaa

SEQ ID NO: 130494 - DNA, 41 bp, Homo sapiens; identical to SEQ ID NO: 100971
  chr9:20620713-20620754
  Hyper

SEQ ID NO: 130495 - DNA, 424 bp, Homo sapiens; identical to SEQ ID NO: 32402
  chr9:21031412-21031836
  Hyper

SEQ ID NO: 130496 - DNA, 328 bp, Homo sapiens; identical to SEQ ID NO: 100973
  chr9:21395999-21396327
  Hyper

SEQ ID NO: 130497 - DNA, 706 bp, Homo sapiens; identical to SEQ ID NO: 100974
  chr9:21402440-21403146
  Hyper

SEQ ID NO: 130498 - DNA, 97 bp, Homo sapiens; identical to SEQ ID NO: 100976
  chr9:21559247-21559344
  Hyper

SEQ ID NO: 130499 - DNA, 343 bp, Homo sapiens; identical to SEQ ID NO: 100977
  chr9:21559775-21560118
  Hyper

SEQ ID NO: 130500 - DNA, 875 bp, Homo sapiens
  chr9:21964911-21965786
  Hyper
tttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctccca

SEQ ID NO: 130501 - DNA, 42 bp, Homo sapiens; identical to SEQ ID NO: 100981
  chr9:21967367-21967409
  Hyper

SEQ ID NO: 130502 - DNA, 569 bp, Homo sapiens
  chr9:21968159-21968728
  Hyper
gccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacg

SEQ ID NO: 130503 - DNA, 92 bp, Homo sapiens; identical to SEQ ID NO: 32411
  chr9:21969169-21969261
  Hyper

SEQ ID NO: 130504 - DNA, 156 bp, Homo sapiens
  chr9:21969732-21969888
  Hyper
agctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttaca

SEQ ID NO: 130505 - DNA, 166 bp, Homo sapiens
  chr9:21970940-21971106
  Hyper
gcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcg

SEQ ID NO: 130506 - DNA, 68 bp, Homo sapiens
  chr9:21971135-21971203
  Hyper
gtcggcgcagttgggctccgcgccgtggagcagcagcagctccgccactcgggcgctgcccatcatca

SEQ ID NO: 130507 - DNA, 1532 bp, Homo sapiens
  chr9:21974163-21975695
  Hyper
acaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagccggaagcagccctcgccagagccagcgttggcaaggaaggaggactgggctcctccccacctgccccccacaccgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctg

SEQ ID NO: 130508 - DNA, 29 bp, Homo sapiens
  chr9:21994208-21994237
  Hyper
gcgggcgcccctggcgctgcccactcccc

SEQ ID NO: 130509 - DNA, 29 bp, Homo sapiens
  chr9:21995297-21995326
  Hyper
accttcacgacagccgcggagcatctgag

SEQ ID NO: 130510 - DNA, 29 bp, Homo sapiens
  chr9:21995720-21995749
  Hyper
ccgggtcctgagcgcggtctaagcgaggc

SEQ ID NO: 130511 - DNA, 113 bp, Homo sapiens
  chr9:22006059-22006172
  Hyper
gacgaccccaggcatcgcgcacgtccagccgcgccccggcccggtgcagcaccaccagcgtgtccaggaagccctcccgggcagcatcatgcaccggtcgggtgagagtggca

SEQ ID NO: 130512 - DNA, 114 bp, Homo sapiens; identical to SEQ ID NO: 100993
  chr9:22010993-22011107
  Hyper

SEQ ID NO: 130513 - DNA, 351 bp, Homo sapiens; identical to SEQ ID NO: 32417
  chr9:22446925-22447276
  Hyper

SEQ ID NO: 130514 - DNA, 207 bp, Homo sapiens; identical to SEQ ID NO: 100995
  chr9:22447488-22447695
  Hyper

SEQ ID NO: 130515 - DNA, 649 bp, Homo sapiens
  chr9:23821013-23821662
  Hyper
tgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgc

SEQ ID NO: 130516 - DNA, 527 bp, Homo sapiens; identical to SEQ ID NO: 100997
  chr9:23822112-23822639
  Hyper

SEQ ID NO: 130517 - DNA, 579 bp, Homo sapiens; identical to SEQ ID NO: 32421
  chr9:23824012-23824591
  Hyper

SEQ ID NO: 130518 - DNA, 223 bp, Homo sapiens; identical to SEQ ID NO: 100999
  chr9:23824795-23825018
  Hyper

SEQ ID NO: 130519 - DNA, 338 bp, Homo sapiens; identical to SEQ ID NO: 101000
  chr9:23825602-23825940
  Hyper

SEQ ID NO: 130520 - DNA, 182 bp, Homo sapiens; identical to SEQ ID NO: 101001
  chr9:23826293-23826475
  Hyper

SEQ ID NO: 130521 - DNA, 40 bp, Homo sapiens; identical to SEQ ID NO: 32423
  chr9:23829874-23829914
  Hyper

SEQ ID NO: 130522 - DNA, 30 bp, Homo sapiens; identical to SEQ ID NO: 32424
  chr9:23830739-23830769
  Hyper

SEQ ID NO: 130523 - DNA, 384 bp, Homo sapiens
  chr9:23831100-23831484
  Hyper
ctctggcccctttaccgggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcctcggctctcacacgcgctcacacttttacccccacgtgtgttcagatcaaacccttgtcccacagagcaagtgccggcaccgggccacggtgacaaaggcggagtttgtatcag

SEQ ID NO: 130524 - DNA, 30 bp, Homo sapiens; identical to SEQ ID NO: 32427
  chr9:23831747-23831777
  Hyper

SEQ ID NO: 130525 - DNA, 58 bp, Homo sapiens; identical to SEQ ID NO: 101007
  chr9:23849841-23849899
  Hyper

SEQ ID NO: 130526 - DNA, 117 bp, Homo sapiens; identical to SEQ ID NO: 101008
  chr9:23850410-23850527
  Hyper

SEQ ID NO: 130527 - DNA, 384 bp, Homo sapiens; identical to SEQ ID NO: 101009
  chr9:23850798-23851182
  Hyper

SEQ ID NO: 130528 - DNA, 74 bp, Homo sapiens; identical to SEQ ID NO: 101010
  chr9:25678053-25678127
  Hyper

SEQ ID NO: 130529 - DNA, 19 bp, Homo sapiens
  chr9:26796964-26796983
  Hypo
aactatttttcaaatcgaa

SEQ ID NO: 130530 - DNA, 30 bp, Homo sapiens; identical to SEQ ID NO: 42109
  chr9:26958024-26958054
  Hypo

SEQ ID NO: 130531 - DNA, 259 bp, Homo sapiens; identical to SEQ ID NO: 101018
  chr9:26976028-26976287
  Hypo

SEQ ID NO: 130532 - DNA, 18 bp, Homo sapiens
  chr9:26976347-26976365
  Hypo
ttgcgcagtagggtgctt

SEQ ID NO: 130533 - DNA, 30 bp, Homo sapiens; identical to SEQ ID NO: 101020
  chr9:27080231-27080261
  Hypo

SEQ ID NO: 130534 - DNA, 30 bp, Homo sapiens; identical to SEQ ID NO: 101022
  chr9:27282428-27282458
  Hypo

SEQ ID NO: 130535 - DNA, 36 bp, Homo sapiens; identical to SEQ ID NO: 101023
  chr9:27610868-27610904
  Hypo

SEQ ID NO: 130536 - DNA, 31 bp, Homo sapiens; identical to SEQ ID NO: 42111
  chr9:28641312-28641343
  Hypo

SEQ ID NO: 130537 - DNA, 1029 bp, Homo sapiens
  chr9:29211799-29212828
  Hyper
tcccctagctcacctcggagcagcctggcccagaccaaccacccagcgttctccgcaaaaaacttcccttaaagcagccaaatattcaagggaggcgggggaaattgggcattagttcgaatacacatacaacagagcaccacggagcaacactgaaaggcaccttttttagatacagaccctatagactctctctcacccttcactccctcccaccctgagtatctgactgagaatttacagagaaccaagaggcgaaaggagagtggaggagaaagagggcattacctcccggggctgccctcagggtgcgggtcaggatctcatccccgaagtggctccagttcaaggcacagctttccagagctcagccgggttcggacctgcgtccccgcggcgcggtgcggagctcggaagcgcgccgggactgccgctcacgtcccccgcccctgccgcgcgggctccgccaccccgcgagcacgctggctctccgcgctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgacttgccaggcgggtcgtgcgatcgcgtagcgacgcccggagagatcc

SEQ ID NO: 130538 - DNA, 2007 bp, Homo sapiens; identical to SEQ ID NO: 101028
  chr9:29213127-29215134
  Hyper

SEQ ID NO: 130539 - DNA, 54 bp, Homo sapiens; identical to SEQ ID NO: 101030
  chr9:29826623-29826677
  Hypo

SEQ ID NO: 130540 - DNA, 20 bp, Homo sapiens
  chr9:32253117-32253137
  Hypo
gctggaggccgggcgcggtg

SEQ ID NO: 130541 - DNA, 75 bp, Homo sapiens; identical to SEQ ID NO: 101033
  chr9:32755910-32755985
  Hypo

SEQ ID NO: 130542 - DNA, 1271 bp, Homo sapiens
  chr9:32782592-32783863
  Hyper
gccagtcttgccccccggggccagaggaatccatctgcccctgcctaccagagcgggaggaacgcaggctctcaatgcctgcttcagcaagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactccgcctgggcgctggttctgtgcgctcccgcggcgcagtcgctccgctgcaagagcgctttcgcgcgccgccaccgcccagagccgggaccaaagcagtcctcgggcaccggctccccgagggacacacacccccccgcgccccgagtcgaggggttgagagaagggcggtcggggagcccctgggcctgccgtcagtcacccggatttgtaactggagaagggtgcgggtcccggagggacatctccagctggcacctaactcctcggatcccggactgggagcccgagctcggatattgcaacggctgccccgtgggcaaaccgaccctggtttccgactccggccactggcagcctcgcgccccagacccttcccgggcacggaagcgggtcaggtcgccctgctcagcctccggaacggcggcggcacaaaccccggccgctcccagcagccccgacgagaccccgggcagcgcctgccgccgggtggcctccctctggggctgaccccctcgcgcccccgcgcgtctgtctgcgtttctgagcctgctctgacagtgatgtaacaaggccaggctcgcgccgcgtcccctctttcccagactcagtgctccctcctcctcccgcgccccgcgctctgcgcgctgagctggcgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgctgtgggggcttctgaggagacagcctggcttctttccctacttcctggagagggcaggaaacctcaggtacctcgttgaccccagccggagcgtgttgatatgagagagagacggaggttgcaatag

SEQ ID NO: 130543 - DNA, 24 bp, Homo sapiens
  chr9:32828442-32828466
  Hypo
cagaaaaaaagctctcggccaggc

SEQ ID NO: 130544 - DNA, 420 bp, Homo sapiens; identical to SEQ ID NO: 101039
  chr9:32999936-33000356
  Hypo

SEQ ID NO: 130545 - DNA, 33 bp, Homo sapiens; identical to SEQ ID NO: 101040
  chr9:33077261-33077294
  Hypo

SEQ ID NO: 130546 - DNA, 30 bp, Homo sapiens; identical to SEQ ID NO: 101041
  chr9:33136558-33136588
  Hypo

SEQ ID NO: 130547 - DNA, 30 bp, Homo sapiens; identical to SEQ ID NO: 101042
  chr9:33306864-33306894
  Hypo

SEQ ID NO: 130548 - DNA, 157 bp, Homo sapiens; identical to SEQ ID NO: 101043
  chr9:33418331-33418488
  Hypo

SEQ ID NO: 130549 - DNA, 111 bp, Homo sapiens; identical to SEQ ID NO: 101044
  chr9:33440312-33440423
  Hypo

SEQ ID NO: 130550 - DNA, 96 bp, Homo sapiens; identical to SEQ ID NO: 101045
  chr9:33447388-33447484
  Hyper

SEQ ID NO: 130551 - DNA, 58 bp, Homo sapiens; identical to SEQ ID NO: 101046
  chr9:33511134-33511192
  Hyper

SEQ ID NO: 130552 - DNA, 300 bp, Homo sapiens; identical to SEQ ID NO: 101047
  chr9:33523978-33524278
  Hyper

SEQ ID NO: 130553 - DNA, 503 bp, Homo sapiens; identical to SEQ ID NO: 101048
  chr9:33524338-33524841
  Hyper

SEQ ID NO: 130554 - DNA, 24 bp, Homo sapiens
  chr9:33647199-33647223
  Hypo
gcgagactgcgtctcaaaaaaaaa

SEQ ID NO: 130555 - DNA, 692 bp, Homo sapiens; identical to SEQ ID NO: 101050
  chr9:33676745-33677437
  Hyper

SEQ ID NO: 130556 - DNA, 30 bp, Homo sapiens; identical to SEQ ID NO: 42114
  chr9:33862299-33862329
  Hypo

SEQ ID NO: 130557 - DNA, 28 bp, Homo sapiens
  chr9:34036390-34036418
  Hypo
aggcgtgagccaccgtgcccagccttga

SEQ ID NO: 130558 - DNA, 36 bp, Homo sapiens; identical to SEQ ID NO: 101053
  chr9:34046353-34046389
  Hypo

SEQ ID NO: 130559 - DNA, 39 bp, Homo sapiens; identical to SEQ ID NO: 42116
  chr9:34062515-34062554
  Hypo

SEQ ID NO: 130560 - DNA, 99 bp, Homo sapiens; identical to SEQ ID NO: 42117
  chr9:34063196-34063295
  Hypo

SEQ ID NO: 130561 - DNA, 57 bp, Homo sapiens; identical to SEQ ID NO: 42118
  chr9:34224348-34224405
  Hypo

SEQ ID NO: 130562 - DNA, 30 bp, Homo sapiens; identical to SEQ ID NO: 101057
  chr9:34279911-34279941
  Hypo

SEQ ID NO: 130563 - DNA, 71 bp, Homo sapiens; identical to SEQ ID NO: 101058
  chr9:34372844-34372915
  Hypo

SEQ ID NO: 130564 - DNA, 139 bp, Homo sapiens; identical to SEQ ID NO: 101059
  chr9:34381074-34381213
  Hyper

SEQ ID NO: 130565 - DNA, 30 bp, Homo sapiens; identical to SEQ ID NO: 101060
  chr9:34494080-34494110
  Hyper

SEQ ID NO: 130566 - DNA, 56 bp, Homo sapiens; identical to SEQ ID NO: 42119
  chr9:34574808-34574864
  Hypo

SEQ ID NO: 130567 - DNA, 30 bp, Homo sapiens; identical to SEQ ID NO: 101062
  chr9:34577915-34577945
  Hyper

SEQ ID NO: 130568 - DNA, 603 bp, Homo sapiens; identical to SEQ ID NO: 101063
  chr9:34588995-34589598
  Hyper

SEQ ID NO: 130569 - DNA, 356 bp, Homo sapiens; identical to SEQ ID NO: 101064
  chr9:34589889-34590245
  Hyper

SEQ ID NO: 130570 - DNA, 201 bp, Homo sapiens; identical to SEQ ID NO: 101065
  chr9:34591455-34591656
  Hyper

SEQ ID NO: 130571 - DNA, 168 bp, Homo sapiens; identical to SEQ ID NO: 101066
  chr9:34665047-34665215
  Hyper

SEQ ID NO: 130572 - DNA, 57 bp, Homo sapiens; identical to SEQ ID NO: 101067
  chr9:34666056-34666113
  Hyper

SEQ ID NO: 130573 - DNA, 395 bp, Homo sapiens; identical to SEQ ID NO: 101068
  chr9:34701358-34701753
  Hyper

SEQ ID NO: 130574 - DNA, 42 bp, Homo sapiens; identical to SEQ ID NO: 101069
  chr9:34702295-34702337
  Hyper

SEQ ID NO: 130575 - DNA, 44 bp, Homo sapiens; identical to SEQ ID NO: 101070
  chr9:34760663-34760707
  Hyper

SEQ ID NO: 130576 - DNA, 480 bp, Homo sapiens
  chr9:34809575-34810055
  Hyper
actgcagagagtgtccgaatgccagcgtcgtgagcctggaggcctagggtgggcagcttggcgagagagcacgagggcgaaagtcgctggaagagtcattctcacccttacgggcaggagcggaacaaagtgttagcggcctcagccctgcgccccctccgggcggacactgttcttgctgcagttggccggctgtttcagtccccgcgccgcagtccagggcgctcgtagagggcgccaactggcacctgggcccactactcatccgagcccatggaaccccacttccgcgtccccccaccgtaagcacgccggtgcccctagctgattcgggaggccagtacctcggggcgcgggggcgcggggcggaacgcagcgcgcgcccacctgccggccaagaaagcctcgcgtgggcgcacgcgccgccgccgcccacgcgccgccgccgccgcccacgcctcaactcggcagctcagccag

SEQ ID NO: 130577 - DNA, 252 bp, Homo sapiens; identical to SEQ ID NO: 101071
  chr9:34957876-34958128
  Hyper

SEQ ID NO: 130578 - DNA, 124 bp, Homo sapiens; identical to SEQ ID NO: 101072
  chr9:34971432-34971556
  Hypo

SEQ ID NO: 130579 - DNA, 38 bp, Homo sapiens; identical to SEQ ID NO: 101073
  chr9:35060862-35060900
  Hypo

SEQ ID NO: 130580 - DNA, 369 bp, Homo sapiens; identical to SEQ ID NO: 101074
  chr9:35162053-35162422
  Hyper

SEQ ID NO: 130581 - DNA, 443 bp, Homo sapiens; identical to SEQ ID NO: 101076
  chr9:35616922-35617365
  Hyper

SEQ ID NO: 130582 - DNA, 637 bp, Homo sapiens
  chr9:35675494-35676131
  Hyper
ggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctg

SEQ ID NO: 130583 - DNA, 30 bp, Homo sapiens; identical to SEQ ID NO: 42120
  chr9:35696547-35696577
  Hypo

SEQ ID NO: 130584 - DNA, 30 bp, Homo sapiens; identical to SEQ ID NO: 101080
  chr9:35712225-35712255
  Hypo

SEQ ID NO: 130585 - DNA, 65 bp, Homo sapiens; identical to SEQ ID NO: 9890
  chr9:35728859-35728924
  Hyper

SEQ ID NO: 130586 - DNA, 95 bp, Homo sapiens; identical to SEQ ID NO: 42121
  chr9:35816242-35816337
  Hypo

SEQ ID NO: 130587 - DNA, 22 bp, Homo sapiens
  chr9:36036080-36036102
  Hypo
aggcacagtggctcacgcctgc

SEQ ID NO: 130588 - DNA, 850 bp, Homo sapiens; identical to SEQ ID NO: 101084
  chr9:36036783-36037633
  Hyper

SEQ ID NO: 130589 - DNA, 30 bp, Homo sapiens; identical to SEQ ID NO: 101086
  chr9:36138930-36138960
  Hypo

SEQ ID NO: 130590 - DNA, 30 bp, Homo sapiens; identical to SEQ ID NO: 101087
  chr9:36162445-36162475
  Hypo

SEQ ID NO: 130591 - DNA, 30 bp, Homo sapiens; identical to SEQ ID NO: 101088
  chr9:36162711-36162741
  Hypo

SEQ ID NO: 130592 - DNA, 108 bp, Homo sapiens; identical to SEQ ID NO: 101089
  chr9:36166287-36166395
  Hyper

SEQ ID NO: 130593 - DNA, 28 bp, Homo sapiens
  chr9:36194299-36194327
  Hypo
aggtgtgaaccaccgcacccggtgacaa

SEQ ID NO: 130594 - DNA, 99 bp, Homo sapiens; identical to SEQ ID NO: 101091
  chr9:36257346-36257445
  Hypo

SEQ ID NO: 130595 - DNA, 1163 bp, Homo sapiens
  chr9:36257855-36259018
  Hyper
aacgtttctcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcatcccccctgattggacagcactgttccaggggacaagtcaacctgggcctccctctacatcccctcccctgctcatcagggcccaccccgagccacacggcggagccctgaattgggccaaagaggtgccctatggtgaggcctgcaggacattgggcgagagccgggtccagtgtgggcctcggggcgcggtggggtggaaagcggccggggaggggaggcctggggcaggaggccgggggaggcggccctgggggtgggcaggatgctctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccgcgctggagctgctgcggggctgtcctgccagcttgtgctcccgccccgaagcgtcctcctccactggcgacacacgcactgaagcccgagtcttcccgctgggtagttgttttggtcttgcacccaaggagggatttcttgcgcctcttgttccctcagttatttcataaaccaggaccgcaactatactgtcgtgtagcgcggccaccccacagcggtccctgacgttaacccttgccgtgactgctagaagacactggtggagtgtgaattgatgaccaaggcatggcagagcctctctcatctttataatcagttcagcggcggcctccactacagggaactcccagccagtcccgaggcctagggaca

SEQ ID NO: 130596 - DNA, 24 bp, Homo sapiens
  chr9:36274726-36274750
  Hypo
ttttttctcttgagacggagtctc

SEQ ID NO: 130597 - DNA, 22 bp, Homo sapiens
  chr9:36318367-36318389
  Hypo
aggaagaaaaagttccgttggg

SEQ ID NO: 130598 - DNA, 582 bp, Homo sapiens
  chr9:36739447-36740029
  Hyper
tctcttgcgctacagcgaatccaagaaaataattaaagctttaatttatttatacgtcttctctatagatattatagatctcacaatcgccgcctcctaatttatgcacgcagagcctgcggcagctcggagccgccagggttggggggtccgggcccctcggagcgggacggctgtcagcccccgcggtggccgcacaaaggctggggtcccggcgggcgcacctgggtgatgggcacctcccgagactccccgggacggaggcctgacagcgcgcggcggccgccttaatagactgcgggatgttctccgggagaaggctgcgccggtccccgaggacagatcatcaggcagagtggtccccggagcaggatttattagcagacaggatggggaagttgattagcctccgcggctgaacggacatcctgtcagacaggcctcttaatccaatcacttacctgtggaggggagccggctgcctcctcctggcccccttcctcctcccatggcacctgcggggccacgcggggtgctccggagccagggtacacaggccaggccttccgtgcctggcctcgc

SEQ ID NO: 130599 - DNA, 123 bp, Homo sapiens; identical to SEQ ID NO: 101098
  chr9:36748460-36748583
  Hyper

SEQ ID NO: 130600 - DNA, 631 bp, Homo sapiens
  chr9:37002482-37003113
  Hyper
cctttcccgtgttcacgaaaaggacagcgtgcgggccgggggactcgctcctctgcaggtaaggggggtgttcgcgggcacctctgctgccacccgcgaccgagcgccggaaacagaccccgtggagcgcatccccgacggggctgcgcgggcctctcttaccttcgtctctcttgcgcttgttggtgtcggcgctgggggacgtgatgcccaggatgccgctgatggagtacgacgagccggccgaatccgtgctcaccgaggacacctgcgtcacggagccagtggacactgcgcggagaaagacgggcggtcagggccgcagagggctgagggcggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccagcctatccatggatgcaggaagcaggggatggagagga

SEQ ID NO: 130601 - DNA, 31 bp, Homo sapiens; identical to SEQ ID NO: 101101
  chr9:37003173-37003204
  Hyper

SEQ ID NO: 130602 - DNA, 2760 bp, Homo sapiens
  chr9:37025306-37028066
  Hyper
agacacggacatgctcgccccgggaagctcaccttcactccagccgggtctctgctgcctttgttaaataggggacctgcggctaggaaagctggatcccaggctgttgggatgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcagcaaacagaaaggaaacgcgattcgttccacttggaatttccttgaaatctccgaatctaatccggcgttaactcaccgtgagaggagcgctcatctcacaggaggctgtggtaatgggtgaattggcaggatccctgcgggccaggcagccaggccggccttgccctcgccctaaatgacccttcccgtctcctacacacgctgcgtctttcagaggcgggggtgcctgcgtggtaactaattggcttcctctttctttctttctttttcgtttcttatcctctttttttaaaggggagaagccatgagaaaaggcgtcctgcagagaaggacccaatggggtctttaagggtctctgtatgaactggccggctcctaagcagaagctgaactcagaaaccgctacttccttgatttttcaaagccccctcctcaactccaggacgcctttggagccctagccccggtgtcctcgcttagctctcaacctcttcctccacacatacagacacgggtcagggccccactatccctccaagcgccagtctggatcagccccatggctgaaaaaggcgccatcggagtaggggtgtggggcgctgtctgagactctgactggcctctccctacaacttactgccctccaactggcctggcccggagccctctacgggtccaagccagggttctccgaaagagctgaaatgtcgccgccggagccttgaaaggctgcagctcgctgcccaagctacgcgttgccggaggcgggattcccaggtgcctcagcccgggcggccaagtgcgttgtttcaggtcccctgcctgggatccctgcactttgcaaagttagctgcgcggctgcagaggtccgagatccttccggccttagtacctgacccacggtccggcacccccaacccggtcccggcgggagagtgagagaagcgagctcgccgcctacttactatgcatggatgcaaacgggtcgtgcttacagtgtatttccatcggggcgctccagactgcaggccggcccacgccgccgcctcccggcgccaaggggctgcccagggcggatagggagcctcgccaccaggccaggcactgtgcgagctgggctcagaaaacactgctggagcttcggggtctctctcagagcctccctgctggagaccgcccggagctgcgcggagaggcgggaaatggtgctagcgcacccgggctaggagcgggtgcccaactccggctggcttccctccctggctggctcaagcagcagctccgggcccagcccggggtagctgcggccaaggcgcccgcggcttcgggggcatagcgtaggggcccgcctccgggacagccagcagcccccggccccaggaaggagcagctttgaggaggccgccggaacaatcggcccttgacttcactcagggggcggagagacccgggggctgccaggctggttccgcggcctcgatgcttctgaggtccctcctcgacccctcggtctccgccagatcctttctttctctgcttctccgagtctctggggctcggacttgccccctccgcctctctccaactggctctccgacgtctcggacgaagttgcaaagaacttcctctccggcagcgcggggtcctggcgggtttggagatgcttccgcccctgacgctggggccgcgactccggagtccccgggagcgtgcagccctccaacactgagacccgctgccttcaaagttcccgcggcccccgctgctcgcccatcgctgggaccaggaacggggacaccagcgacggactcttcctcgccggggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaagcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccccacagcgatgctgggatcctgggacgctctcaaggcttg

SEQ ID NO: 130603 - DNA, 40 bp, Homo sapiens; identical to SEQ ID NO: 32465
  chr9:37028470-37028510
  Hyper

SEQ ID NO: 130604 - DNA, 30 bp, Homo sapiens; identical to SEQ ID NO: 32466
  chr9:37028944-37028974
  Hyper

SEQ ID NO: 130605 - DNA, 1442 bp, Homo sapiens; identical to SEQ ID NO: 101108
  chr9:37029348-37030790
  Hyper

SEQ ID NO: 130606 - DNA, 750 bp, Homo sapiens; identical to SEQ ID NO: 32469
  chr9:37034197-37034947
  Hyper

SEQ ID NO: 130607 - DNA, 380 bp, Homo sapiens; identical to SEQ ID NO: 101110
  chr9:37035506-37035886
  Hyper

SEQ ID NO: 130608 - DNA, 2227 bp, Homo sapiens; identical to SEQ ID NO: 101111
  chr9:37036127-37038354
  Hyper

SEQ ID NO: 130609 - DNA, 215 bp, Homo sapiens; identical to SEQ ID NO: 101112
  chr9:37121892-37122107
  Hypo

SEQ ID NO: 130610 - DNA, 30 bp, Homo sapiens; identical to SEQ ID NO: 42125
  chr9:37134066-37134096
  Hypo

SEQ ID NO: 130611 - DNA, 30 bp, Homo sapiens; identical to SEQ ID NO: 5089
  chr9:37467610-37467640
  Hypo

SEQ ID NO: 130612 - DNA, 30 bp, Homo sapiens; identical to SEQ ID NO: 5090
  chr9:37467940-37467970
  Hypo

SEQ ID NO: 130613 - DNA, 41 bp, Homo sapiens; identical to SEQ ID NO: 101116
  chr9:37477115-37477156
  Hypo

SEQ ID NO: 130614 - DNA, 291 bp, Homo sapiens; identical to SEQ ID NO: 101117
  chr9:37576058-37576349
  Hyper

SEQ ID NO: 130615 - DNA, 38 bp, Homo sapiens; identical to SEQ ID NO: 101118
  chr9:37651342-37651380
  Hyper

SEQ ID NO: 130616 - DNA, 30 bp, Homo sapiens; identical to SEQ ID NO: 101120
  chr9:37965461-37965491
  Hypo

SEQ ID NO: 130617 - DNA, 30 bp, Homo sapiens; identical to SEQ ID NO: 101121
  chr9:38067678-38067708
  Hyper

SEQ ID NO: 130618 - DNA, 37 bp, Homo sapiens; identical to SEQ ID NO: 101122
  chr9:38068121-38068158
  Hyper

SEQ ID NO: 130619 - DNA, 161 bp, Homo sapiens; identical to SEQ ID NO: 101123
  chr9:38189469-38189630
  Hypo

SEQ ID NO: 130620 - DNA, 436 bp, Homo sapiens; identical to SEQ ID NO: 101124
  chr9:38424302-38424738
  Hyper

SEQ ID NO: 130621 - DNA, 350 bp, Homo sapiens; identical to SEQ ID NO: 101125
  chr9:38620053-38620403
  Hyper

SEQ ID NO: 130622 - DNA, 86 bp, Homo sapiens; identical to SEQ ID NO: 101126
  chr9:38620735-38620821
  Hyper

SEQ ID NO: 130623 - DNA, 360 bp, Homo sapiens; identical to SEQ ID NO: 101127
  chr9:38620881-38621241
  Hyper

SEQ ID NO: 130624 - DNA, 565 bp, Homo sapiens; identical to SEQ ID NO: 101128
  chr9:38621421-38621986
  Hyper

SEQ ID NO: 130625 - DNA, 85 bp, Homo sapiens; identical to SEQ ID NO: 101129
  chr9:38622559-38622644
  Hyper

SEQ ID NO: 130626 - DNA, 31 bp, Homo sapiens; identical to SEQ ID NO: 42128
  chr9:38646913-38646944
  Hypo

SEQ ID NO: 130627 - DNA, 121 bp, Homo sapiens; identical to SEQ ID NO: 101131
  chr9:40633719-40633840
  Hyper

SEQ ID NO: 130628 - DNA, 23 bp, Homo sapiens
  chr9:41242566-41242589
  Hypo
aagaatgaatatggccggtcttg

SEQ ID NO: 130629 - DNA, 129 bp, Homo sapiens; identical to SEQ ID NO: 101136
  chr9:43684951-43685080
  Hyper

SEQ ID NO: 130630 - DNA, 24 bp, Homo sapiens
  chr9:45356983-45357007
  Hyper
gcgtgcgctcgaggcctgagggac

SEQ ID NO: 130631 - DNA, 41 bp, Homo sapiens; identical to SEQ ID NO: 101138
  chr9:45371461-45371502
  Hypo

SEQ ID NO: 130632 - DNA, 152 bp, Homo sapiens; identical to SEQ ID NO: 101148
  chr9:66455725-66455877
  Hyper

SEQ ID NO: 130633 - DNA, 32 bp, Homo sapiens; identical to SEQ ID NO: 101149
  chr9:66455997-66456029
  Hyper

SEQ ID NO: 130634 - DNA, 300 bp, Homo sapiens; identical to SEQ ID NO: 101150
  chr9:66458292-66458592
  Hyper

SEQ ID NO: 130635 - DNA, 180 bp, Homo sapiens; identical to SEQ ID NO: 101151
  chr9:66494095-66494275
  Hyper

SEQ ID NO: 130636 - DNA, 127 bp, Homo sapiens; identical to SEQ ID NO: 101155
  chr9:69197629-69197756
  Hyper

SEQ ID NO: 130637 - DNA, 30 bp, Homo sapiens; identical to SEQ ID NO: 101156
  chr9:70652569-70652599
  Hypo

SEQ ID NO: 130638 - DNA, 120 bp, Homo sapiens; identical to SEQ ID NO: 101157
  chr9:71200600-71200720
  Hypo

SEQ ID NO: 130639 - DNA, 176 bp, Homo sapiens; identical to SEQ ID NO: 101158
  chr9:71223791-71223967
  Hypo

SEQ ID NO: 130640 - DNA, 29 bp, Homo sapiens
  chr9:71369369-71369398
  Hypo
ccaccacgcccggccggttccatgatttt

SEQ ID NO: 130641 - DNA, 106 bp, Homo sapiens; identical to SEQ ID NO: 42130
  chr9:71425241-71425347
  Hypo

SEQ ID NO: 130642 - DNA, 27 bp, Homo sapiens
  chr9:71500809-71500836
  Hypo
aaatttggccaggtgcggtggctcacg

SEQ ID NO: 130643 - DNA, 27 bp, Homo sapiens
  chr9:71501076-71501103
  Hypo
agagcgagactccgtctgaaaaaaaaa

SEQ ID NO: 130644 - DNA, 35 bp, Homo sapiens; identical to SEQ ID NO: 101163
  chr9:71576130-71576165
  Hypo

SEQ ID NO: 130645 - DNA, 82 bp, Homo sapiens; identical to SEQ ID NO: 101164
  chr9:71583902-71583984
  Hypo

SEQ ID NO: 130646 - DNA, 18 bp, Homo sapiens
  chr9:71655284-71655302
  Hypo
atgtaaatatttatacgc

SEQ ID NO: 130647 - DNA, 30 bp, Homo sapiens; identical to SEQ ID NO: 101167
  chr9:71704692-71704722
  Hypo

SEQ ID NO: 130648 - DNA, 120 bp, Homo sapiens; identical to SEQ ID NO: 42133
  chr9:71734802-71734922
  Hypo

SEQ ID NO: 130649 - DNA, 19 bp, Homo sapiens
  chr9:71738790-71738809
  Hypo
ttatttattttgagacgga

SEQ ID NO: 130650 - DNA, 463 bp, Homo sapiens
  chr9:71788950-71789413
  Hyper
cccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctggg

SEQ ID NO: 130651 - DNA, 61 bp, Homo sapiens; identical to SEQ ID NO: 32483
  chr9:71789696-71789757
  Hyper

SEQ ID NO: 130652 - DNA, 27 bp, Homo sapiens
  chr9:71921187-71921214
  Hypo
tctgggcaagatgatcgccctgaataa

SEQ ID NO: 130653 - DNA, 251 bp, Homo sapiens; identical to SEQ ID NO: 101173
  chr9:71939733-71939984
  Hyper

SEQ ID NO: 130654 - DNA, 30 bp, Homo sapiens; identical to SEQ ID NO: 101174
  chr9:72286957-72286987
  Hyper

SEQ ID NO: 130655 - DNA, 44 bp, Homo sapiens; identical to SEQ ID NO: 42135
  chr9:72819967-72820011
  Hypo

SEQ ID NO: 130656 - DNA, 269 bp, Homo sapiens; identical to SEQ ID NO: 101176
  chr9:73027315-73027584
  Hyper

SEQ ID NO: 130657 - DNA, 336 bp, Homo sapiens; identical to SEQ ID NO: 101177
  chr9:73027969-73028305
  Hyper

SEQ ID NO: 130658 - DNA, 34 bp, Homo sapiens; identical to SEQ ID NO: 101178
  chr9:73032801-73032835
  Hypo

SEQ ID NO: 130659 - DNA, 30 bp, Homo sapiens; identical to SEQ ID NO: 101180
  chr9:73438545-73438575
  Hypo

SEQ ID NO: 130660 - DNA, 448 bp, Homo sapiens
  chr9:74061662-74062110
  Hyper
ctccggctgcgtctgcggctctccgcgttgtcctcgcggtcggagcagccccgctccatttccgccgcatccctccacttcttccccatgagaagttcgcctccctcggccgggaaacagcccagcgccgagcgctctcgctggctcctcgccgcgggtctccctccagcctgcgcgcggctctcggttggcgctgcctttgcctccgccggctcctgccagagccccgcgctccgttaccgccgccgccaccaggctgcgcttgcgcccgcgattggctcaactgtgggctggggctgcgagcgccacctgcgcccgagccagctttcttttgcgtccccaaattgctctccacccggcagccgccgccttctctggagagtgcagggcccacgcctgaggctgttgatgcgccgcagggtagcgctcccagcggtcacctcaccct

SEQ ID NO: 130661 - DNA, 173 bp, Homo sapiens; identical to SEQ ID NO: 42137
  chr9:74469850-74470023
  Hypo

SEQ ID NO: 130662 - DNA, 582 bp, Homo sapiens; identical to SEQ ID NO: 101184
  chr9:74764297-74764879
  Hyper

SEQ ID NO: 130663 - DNA, 30 bp, Homo sapiens; identical to SEQ ID NO: 101185
  chr9:75545858-75545888
  Hypo

SEQ ID NO: 130664 - DNA, 22 bp, Homo sapiens
  chr9:76966084-76966106
  Hypo
ggcaccgcgcctggcctgcatt

SEQ ID NO: 130665 - DNA, 606 bp, Homo sapiens; identical to SEQ ID NO: 101187
  chr9:77111763-77112369
  Hyper

SEQ ID NO: 130666 - DNA, 2249 bp, Homo sapiens
  chr9:77112703-77114952
  Hyper
ttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgaggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcagggtggacacgcgcgggcacacactcgccaggttacgaggcccactaagcgtcctggccagcaggcatgtcccttcgctggagtagcaagcagaagagcagtgctgcgaggctggacgcggctgaggaaacagttagttccccggcacgcggctgaggaaacagttctgcggcgcgcgccttcgtgccggcgctgcgccctggccaggtcctcgtgcccgagcccgcgcggcccagggagtagtgcgaccccggaaaagttgtaatgagaaagttctggaggcttggaaaggccacactgctcacagtcggagagtcatgggctccggctcttttgtcagataaagggccggtagtggaaggaggtgctggtgcaccctcgggccaggaccctcgcagtcgcaggcggtggcggcggcggcggcgggaccccggggcgagctggggtctgcagggatgcgcgccagggactgtagcgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctctatccttcgcacgtacccctgggtcttgacaacagaaagttagtaacggccagctccagaccttcttgcatcccagacccggagagaggtggtctaggcagggagcacttgggagagttgggatgcaatcactggtctcctccttccactgaaagtgatcctctcccacccagtccccctacgcccctagaggagcaccccaggaggcagcgggtctcactcccactccctcccgcacccggtgagccccgagcctggactcaagggtttgctggctggacgctgggatgtgtcaggaaagggaaggagaagaaggaacggagagagactgtccatgggggagggggttgactgtagataagaaacaaggacgtcctgatgggatggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatgggttgtagcttgatctagcatctcctgaaggagcagtttgcagatgactgtcctggttcgccacggcggtcgctttgaggactcc

SEQ ID NO: 130667 - DNA, 274 bp, Homo sapiens; identical to SEQ ID NO: 101192
  chr9:77115210-77115484
  Hyper

SEQ ID NO: 130668 - DNA, 209 bp, Homo sapiens; identical to SEQ ID NO: 32495
  chr9:77502024-77502233
  Hyper

SEQ ID NO: 130669 - DNA, 123 bp, Homo sapiens; identical to SEQ ID NO: 101194
  chr9:77502613-77502736
  Hyper

SEQ ID NO: 130670 - DNA, 30 bp, Homo sapiens; identical to SEQ ID NO: 101195
  chr9:77802622-77802652
  Hypo

SEQ ID NO: 130671 - DNA, 34 bp, Homo sapiens; identical to SEQ ID NO: 101196
  chr9:78505588-78505622
  Hyper

SEQ ID NO: 130672 - DNA, 77 bp, Homo sapiens; identical to SEQ ID NO: 101197
  chr9:78506339-78506416
  Hyper

SEQ ID NO: 130673 - DNA, 256 bp, Homo sapiens; identical to SEQ ID NO: 101198
  chr9:78506476-78506732
  Hyper

SEQ ID NO: 130674 - DNA, 104 bp, Homo sapiens; identical to SEQ ID NO: 101199
  chr9:78507584-78507688
  Hyper

SEQ ID NO: 130675 - DNA, 63 bp, Homo sapiens; identical to SEQ ID NO: 101200
  chr9:78557098-78557161
  Hypo

SEQ ID NO: 130676 - DNA, 78 bp, Homo sapiens; identical to SEQ ID NO: 101201
  chr9:79073402-79073480
  Hypo

SEQ ID NO: 130677 - DNA, 95 bp, Homo sapiens; identical to SEQ ID NO: 101202
  chr9:79231284-79231379
  Hypo

SEQ ID NO: 130678 - DNA, 75 bp, Homo sapiens; identical to SEQ ID NO: 101203
  chr9:79409102-79409177
  Hypo

SEQ ID NO: 130679 - DNA, 30 bp, Homo sapiens; identical to SEQ ID NO: 101204
  chr9:79521303-79521333
  Hyper

SEQ ID NO: 130680 - DNA, 541 bp, Homo sapiens; identical to SEQ ID NO: 32498
  chr9:79626876-79627417
  Hyper

SEQ ID NO: 130681 - DNA, 91 bp, Homo sapiens; identical to SEQ ID NO: 101206
  chr9:79628238-79628329
  Hyper

SEQ ID NO: 130682 - DNA, 714 bp, Homo sapiens
  chr9:79628692-79629406
  Hyper
ctggttgctgatgtgcggagtctttgttattagtcgtcggagggagcgcaagaaagttatttaatttttaatcgttggttatttatttggtggttatggttgtcagtggccgctacctaaacagacacggcccgtaggaaagcttctggatgttggccaagaggtgtgaggcgcgggtggactgtaaaggggaaattgctctgctagggtgacacaaacgcttcccatctccacgctgattgcgcgccccgggccacaggcagtgtacacagccgcggtgttcgagacgaatctcgcctcgaagagtggagatttaaaagtcaggtttctgactctgggcagcacgtagggtctttgcggagtgagtttcggtcagacgagagcctggggtcaatgtcgaggtggagcgacgctggcacggcaaccctgagcctgcgcggcccggcgctatcccctggctctccgctgctggctggacccccttgtatcctccttccctcaaactcgcacacctacggctcagacaacccagccagtctcgcccgcgagcggaggtgctagaaactttgggggacgaaagctgggctgtctttcttggccggtggcactgcgagagaaagccgtgtgcaccccgcggctgaccactccaacgccagatacatccacccgctcatgtaccgccgtcgggcttcattttgtcgagctcttcttagg

SEQ ID NO: 130683 - DNA, 30 bp, Homo sapiens; identical to SEQ ID NO: 101209
  chr9:79629607-79629637
  Hyper

SEQ ID NO: 130684 - DNA, 587 bp, Homo sapiens; identical to SEQ ID NO: 101210
  chr9:79629850-79630437
  Hyper

SEQ ID NO: 130685 - DNA, 1223 bp, Homo sapiens; identical to SEQ ID NO: 101211
  chr9:79631016-79632239
  Hyper

SEQ ID NO: 130686 - DNA, 98 bp, Homo sapiens; identical to SEQ ID NO: 101212
  chr9:79632823-79632921
  Hyper

SEQ ID NO: 130687 - DNA, 2767 bp, Homo sapiens
  chr9:79633212-79635979
  Hyper
gagagaagctcacagcgagtagatgaaaacagggaagggtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctccccggccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggccgggcagagctggcg

SEQ ID NO: 130688 - DNA, 363 bp, Homo sapiens; identical to SEQ ID NO: 101216
  chr9:79636190-79636553
  Hyper

SEQ ID NO: 130689 - DNA, 749 bp, Homo sapiens; identical to SEQ ID NO: 101217
  chr9:79636807-79637556
  Hyper

SEQ ID NO: 130690 - DNA, 628 bp, Homo sapiens
  chr9:79637616-79638244
  Hyper
gctaggattacaggcgtgagccatcacgcccggccaccacctatttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgccgggacactgccgctgccgcatcaactaggcaagcgcgcccagccaccgccgcctagaagacctgttgcgcgccgacaccgcgcctcgcgggaggccacagcctggggcctgggaccgcagagttcttggtgggtgaaagccggcggccaagctgctcgagctgcgggaagggaacccttgggcagcggctgctgcagagctgctctgggagtgggccaggaggccccggcagggtgcggcgcctccgctggggcctgggaagccgcgtcccggcctccgccctccaccctttagcacaggtctactttgaaccagcttccgtgtgcccagccaggccaacgaaagtcacctctg

SEQ ID NO: 130691 - DNA, 223 bp, Homo sapiens; identical to SEQ ID NO: 101220
  chr9:80263294-80263517
  Hyper

SEQ ID NO: 130692 - DNA, 30 bp, Homo sapiens; identical to SEQ ID NO: 101221
  chr9:80263764-80263794
  Hyper

SEQ ID NO: 130693 - DNA, 23 bp, Homo sapiens
  chr9:80303276-80303299
  Hypo
ttcctattcggccatcttggctc

SEQ ID NO: 130694 - DNA, 30 bp, Homo sapiens; identical to SEQ ID NO: 101223
  chr9:80645516-80645546
  Hyper

SEQ ID NO: 130695 - DNA, 35 bp, Homo sapiens; identical to SEQ ID NO: 101224
  chr9:80645867-80645902
  Hyper

SEQ ID NO: 130696 - DNA, 186 bp, Homo sapiens; identical to SEQ ID NO: 101225
  chr9:80646323-80646509
  Hyper

SEQ ID NO: 130697 - DNA, 76 bp, Homo sapiens; identical to SEQ ID NO: 101226
  chr9:80647171-80647247
  Hyper

SEQ ID NO: 130698 - DNA, 58 bp, Homo sapiens; identical to SEQ ID NO: 101227
  chr9:80849784-80849842
  Hypo

SEQ ID NO: 130699 - DNA, 147 bp, Homo sapiens; identical to SEQ ID NO: 101228
  chr9:80852173-80852320
  Hypo

SEQ ID NO: 130700 - DNA, 145 bp, Homo sapiens; identical to SEQ ID NO: 101229
  chr9:80911891-80912036
  Hyper

SEQ ID NO: 130701 - DNA, 148 bp, Homo sapiens; identical to SEQ ID NO: 101230
  chr9:81181130-81181278
  Hypo

SEQ ID NO: 130702 - DNA, 154 bp, Homo sapiens; identical to SEQ ID NO: 101231
  chr9:81358951-81359105
  Hypo

SEQ ID NO: 130703 - DNA, 38 bp, Homo sapiens; identical to SEQ ID NO: 101232
  chr9:82185345-82185383
  Hyper

SEQ ID NO: 130704 - DNA, 60 bp, Homo sapiens; identical to SEQ ID NO: 101233
  chr9:82185643-82185703
  Hyper

SEQ ID NO: 130705 - DNA, 30 bp, Homo sapiens; identical to SEQ ID NO: 101234
  chr9:82336772-82336802
  Hypo

SEQ ID NO: 130706 - DNA, 71 bp, Homo sapiens; identical to SEQ ID NO: 101239
  chr9:84241090-84241161
  Hypo

SEQ ID NO: 130707 - DNA, 37 bp, Homo sapiens; identical to SEQ ID NO: 101242
  chr9:84294953-84294990
  Hypo

SEQ ID NO: 130708 - DNA, 17 bp, Homo sapiens
  chr9:85372740-85372757
  Hypo
gacgggagctgttccta

SEQ ID NO: 130709 - DNA, 577 bp, Homo sapiens; identical to SEQ ID NO: 101244
  chr9:86152387-86152964
  Hyper

SEQ ID NO: 130710 - DNA, 212 bp, Homo sapiens; identical to SEQ ID NO: 101245
  chr9:86153332-86153544
  Hyper

SEQ ID NO: 130711 - DNA, 25 bp, Homo sapiens
  chr9:86537478-86537503
  Hypo
ccaccctgcccggccctatcaggac

SEQ ID NO: 130712 - DNA, 581 bp, Homo sapiens; identical to SEQ ID NO: 32520
  chr9:86755532-86756113
  Hyper

SEQ ID NO: 130713 - DNA, 227 bp, Homo sapiens; identical to SEQ ID NO: 101248
  chr9:86886509-86886736
  Hyper

SEQ ID NO: 130714 - DNA, 767 bp, Homo sapiens; identical to SEQ ID NO: 101249
  chr9:87282999-87283766
  Hyper

SEQ ID NO: 130715 - DNA, 50 bp, Homo sapiens; identical to SEQ ID NO: 101250
  chr9:87284009-87284059
  Hyper

SEQ ID NO: 130716 - DNA, 439 bp, Homo sapiens; identical to SEQ ID NO: 9946
  chr9:87284555-87284994
  Hyper

SEQ ID NO: 130717 - DNA, 565 bp, Homo sapiens
  chr9:87285279-87285844
  Hyper
gtttgtcctcagcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagccta

SEQ ID NO: 130718 - DNA, 30 bp, Homo sapiens; identical to SEQ ID NO: 42145
  chr9:87326719-87326749
  Hypo

SEQ ID NO: 130719 - DNA, 29 bp, Homo sapiens
  chr9:88137397-88137426
  Hyper
acacacacgcacagacgcacactcacgtg

SEQ ID NO: 130720 - DNA, 628 bp, Homo sapiens
  chr9:88137486-88138114
  Hyper
ctgtcagcaagaaaggaaggcaggctgttgagtagggaagtgggagtgcctgccggcgttctcgtctgtccctacttcatccttcctctctcactgtcttacagcaaaggactacagcaaaggcgcgttcagcgcctgcgcggccaggcccggggtgctgggttgcggcttcccgcgggtaaaccctgtcggtacccgatccccgtccgcggaaggccaggagaacgcggttccccttctcgcgtcctctcccttcccgcatctgtggataactcttcccgcatcggcctctctctgctgacattagaaagacgtccctacgccgcggcgagcttcctttgcccctaaaagcactccctttctgtgtgcaggaaaccgcccccgactccgcgcgatcgccctgtgcgcgcaggagtgacaggcgccccagctcgcgctctccagcccgccagggcccggctttggcagacccgaggctcctcacccgccctgagggacgggttgtacttactgagaactgatgcttagtaagcttaaaagccccagaaaggaagtctgtacaaatccttaatgatccagtcaattgtcgctgcataacaaaccaccccagaaccggtaacttgaaaca

SEQ ID NO: 130721 - DNA, 30 bp, Homo sapiens; identical to SEQ ID NO: 42146
  chr9:88832474-88832504
  Hypo

SEQ ID NO: 130722 - DNA, 30 bp, Homo sapiens; identical to SEQ ID NO: 101261
  chr9:89083624-89083654
  Hypo

SEQ ID NO: 130723 - DNA, 67 bp, Homo sapiens; identical to SEQ ID NO: 101262
  chr9:89131689-89131756
  Hypo

SEQ ID NO: 130724 - DNA, 22 bp, Homo sapiens
  chr9:89330755-89330777
  Hypo
ttacaggcgtgagccactgcgc

SEQ ID NO: 130725 - DNA, 30 bp, Homo sapiens; identical to SEQ ID NO: 101264
  chr9:89374984-89375014
  Hypo

SEQ ID NO: 130726 - DNA, 127 bp, Homo sapiens
  chr9:89517708-89517835
  Hyper
ttcccccggcctctgcgggggcgcgcgggctgggaaagggacgaaatggaaaaaccgtcccctccagcaccctcacctccaccgccaccctcacctccaccgccgccgagcccggggtcaaagctgc

SEQ ID NO: 130727 - DNA, 30 bp, Homo sapiens; identical to SEQ ID NO: 101265
  chr9:89518042-89518072
  Hyper

SEQ ID NO: 130728 - DNA, 624 bp, Homo sapiens; identical to SEQ ID NO: 101266
  chr9:89560694-89561318
  Hyper

SEQ ID NO: 130729 - DNA, 30 bp, Homo sapiens; identical to SEQ ID NO: 101267
  chr9:89561749-89561779
  Hyper

SEQ ID NO: 130730 - DNA, 82 bp, Homo sapiens; identical to SEQ ID NO: 101268
  chr9:89563765-89563847
  Hyper

SEQ ID NO: 130731 - DNA, 299 bp, Homo sapiens; identical to SEQ ID NO: 101269
  chr9:89763321-89763620
  Hyper

SEQ ID NO: 130732 - DNA, 30 bp, Homo sapiens; identical to SEQ ID NO: 101270
  chr9:90000239-90000269
  Hypo

SEQ ID NO: 130733 - DNA, 66 bp, Homo sapiens; identical to SEQ ID NO: 101271
  chr9:90112790-90112856
  Hyper

SEQ ID NO: 130734 - DNA, 30 bp, Homo sapiens; identical to SEQ ID NO: 101272
  chr9:90113126-90113156
  Hyper

SEQ ID NO: 130735 - DNA, 113 bp, Homo sapiens
  chr9:90113665-90113778
  Hyper
gggtgccgtggtgcccggccccacgcgcgcgcggggctgaggggtcgggggcgtccctggccgcccagctttaacaaagggtgctcctctccaccccgcgaggaggggcagct

SEQ ID NO: 130736 - DNA, 30 bp, Homo sapiens; identical to SEQ ID NO: 101274
  chr9:90279219-90279249
  Hypo

SEQ ID NO: 130737 - DNA, 161 bp, Homo sapiens; identical to SEQ ID NO: 101275
  chr9:90287605-90287766
  Hypo

SEQ ID NO: 130738 - DNA, 30 bp, Homo sapiens; identical to SEQ ID NO: 101276
  chr9:90316457-90316487
  Hypo

SEQ ID NO: 130739 - DNA, 49 bp, Homo sapiens; identical to SEQ ID NO: 101277
  chr9:90321063-90321112
  Hypo

SEQ ID NO: 130740 - DNA, 165 bp, Homo sapiens; identical to SEQ ID NO: 42147
  chr9:90322123-90322288
  Hypo

SEQ ID NO: 130741 - DNA, 170 bp, Homo sapiens; identical to SEQ ID NO: 101279
  chr9:90331505-90331675
  Hypo

SEQ ID NO: 130742 - DNA, 98 bp, Homo sapiens; identical to SEQ ID NO: 101280
  chr9:90340845-90340943
  Hyper

SEQ ID NO: 130743 - DNA, 79 bp, Homo sapiens; identical to SEQ ID NO: 101281
  chr9:90341264-90341343
  Hyper

SEQ ID NO: 130744 - DNA, 30 bp, Homo sapiens; identical to SEQ ID NO: 101282
  chr9:90386516-90386546
  Hypo

SEQ ID NO: 130745 - DNA, 173 bp, Homo sapiens; identical to SEQ ID NO: 101283
  chr9:90421580-90421753
  Hypo

SEQ ID NO: 130746 - DNA, 30 bp, Homo sapiens; identical to SEQ ID NO: 101284
  chr9:90588928-90588958
  Hyper

SEQ ID NO: 130747 - DNA, 93 bp, Homo sapiens; identical to SEQ ID NO: 32533
  chr9:90589194-90589287
  Hyper

SEQ ID NO: 130748 - DNA, 184 bp, Homo sapiens; identical to SEQ ID NO: 101286
  chr9:90589592-90589776
  Hyper

SEQ ID NO: 130749 - DNA, 84 bp, Homo sapiens; identical to SEQ ID NO: 101287
  chr9:90691103-90691187
  Hyper

SEQ ID NO: 130750 - DNA, 103 bp, Homo sapiens; identical to SEQ ID NO: 101288
  chr9:90749344-90749447
  Hypo

SEQ ID NO: 130751 - DNA, 193 bp, Homo sapiens; identical to SEQ ID NO: 101289
  chr9:91149133-91149326
  Hyper

SEQ ID NO: 130752 - DNA, 30 bp, Homo sapiens; identical to SEQ ID NO: 101290
  chr9:91149724-91149754
  Hyper

SEQ ID NO: 130753 - DNA, 409 bp, Homo sapiens; identical to SEQ ID NO: 101291
  chr9:91149976-91150385
  Hyper

SEQ ID NO: 130754 - DNA, 40 bp, Homo sapiens; identical to SEQ ID NO: 32536
  chr9:91150621-91150661
  Hyper

SEQ ID NO: 130755 - DNA, 69 bp, Homo sapiens; identical to SEQ ID NO: 101293
  chr9:91321072-91321141
  Hypo

SEQ ID NO: 130756 - DNA, 398 bp, Homo sapiens; identical to SEQ ID NO: 32537
  chr9:91605965-91606363
  Hyper

SEQ ID NO: 130757 - DNA, 30 bp, Homo sapiens; identical to SEQ ID NO: 32538
  chr9:91606806-91606836
  Hyper

SEQ ID NO: 130758 - DNA, 1242 bp, Homo sapiens; identical to SEQ ID NO: 101296
  chr9:91792357-91793599
  Hyper

SEQ ID NO: 130759 - DNA, 344 bp, Homo sapiens; identical to SEQ ID NO: 101297
  chr9:91849514-91849858
  Hyper

SEQ ID NO: 130760 - DNA, 30 bp, Homo sapiens; identical to SEQ ID NO: 101298
  chr9:91870244-91870274
  Hypo

SEQ ID NO: 130761 - DNA, 267 bp, Homo sapiens; identical to SEQ ID NO: 101299
  chr9:91995936-91996203
  Hypo

SEQ ID NO: 130762 - DNA, 101 bp, Homo sapiens; identical to SEQ ID NO: 101300
  chr9:92163460-92163561
  Hypo

SEQ ID NO: 130763 - DNA, 30 bp, Homo sapiens; identical to SEQ ID NO: 101301
  chr9:92800931-92800961
  Hypo

SEQ ID NO: 130764 - DNA, 159 bp, Homo sapiens; identical to SEQ ID NO: 42151
  chr9:92897057-92897216
  Hypo

SEQ ID NO: 130765 - DNA, 77 bp, Homo sapiens; identical to SEQ ID NO: 15229
  chr9:92980516-92980593
  Hypo

SEQ ID NO: 130766 - DNA, 290 bp, Homo sapiens; identical to SEQ ID NO: 101304
  chr9:93404961-93405251
  Hyper

SEQ ID NO: 130767 - DNA, 197 bp, Homo sapiens; identical to SEQ ID NO: 101305
  chr9:93462703-93462900
  Hypo

SEQ ID NO: 130768 - DNA, 46 bp, Homo sapiens; identical to SEQ ID NO: 101306
  chr9:93564410-93564456
  Hyper

SEQ ID NO: 130769 - DNA, 32 bp, Homo sapiens; identical to SEQ ID NO: 101307
  chr9:93698029-93698061
  Hypo

SEQ ID NO: 130770 - DNA, 158 bp, Homo sapiens; identical to SEQ ID NO: 101308
  chr9:93901190-93901348
  Hypo

SEQ ID NO: 130771 - DNA, 248 bp, Homo sapiens; identical to SEQ ID NO: 101309
  chr9:93955929-93956177
  Hyper

SEQ ID NO: 130772 - DNA, 213 bp, Homo sapiens; identical to SEQ ID NO: 101310
  chr9:93956444-93956657
  Hyper

SEQ ID NO: 130773 - DNA, 480 bp, Homo sapiens; identical to SEQ ID NO: 101311
  chr9:94183464-94183944
  Hyper

SEQ ID NO: 130774 - DNA, 32 bp, Homo sapiens; identical to SEQ ID NO: 101312
  chr9:94187211-94187243
  Hyper

SEQ ID NO: 130775 - DNA, 42 bp, Homo sapiens; identical to SEQ ID NO: 101313
  chr9:94486293-94486335
  Hypo

SEQ ID NO: 130776 - DNA, 30 bp, Homo sapiens; identical to SEQ ID NO: 42155
  chr9:94572598-94572628
  Hypo

SEQ ID NO: 130777 - DNA, 87 bp, Homo sapiens; identical to SEQ ID NO: 101315
  chr9:94573085-94573172
  Hypo

SEQ ID NO: 130778 - DNA, 93 bp, Homo sapiens; identical to SEQ ID NO: 101316
  chr9:94579436-94579529
  Hypo

SEQ ID NO: 130779 - DNA, 141 bp, Homo sapiens; identical to SEQ ID NO: 42157
  chr9:94658109-94658250
  Hypo

SEQ ID NO: 130780 - DNA, 22 bp, Homo sapiens
  chr9:94685022-94685044
  Hypo
ccgcgcccgaccaagaatattt

SEQ ID NO: 130781 - DNA, 1986 bp, Homo sapiens
  chr9:94711102-94713088
  Hyper
tgggcctgaaggccccgcccgccctcctccacccccgcagggtgccgagaatccggcccgaggcgcgcgggcgggaggtgctcccggagtctgcaccgccagagctaacgccgcctcctccaggcaacctaggcaggtcccaagctgcacttccgaacctccccgccgttcctctgcgccccggatccaagcagccgaaaccgcgcagggactcgggggaagtggggccccgggaggaaacccacctaggagccgggccccgcccctcccgccgccagcctcctacaggtcccgggggtccccccggcgcggccagaaggcggccgcgccccagccgctcagggacccgcgatcccagtcacaaaccatttcaatccagatcacacaccacttcggccaccccagagcggtgggggagaggaggtttcagggaccaacaaaagggatgccaaagagcccgtttccatcaagcggcccgcgggctgggaaagtcaggacccgggagccgccggcgcccccacccccgccgcaagagccgcttctccggggccacgtccaccccaggattctgccaggcatcaggccgccctgggggtggggggacgctccgagacagacgggggacactcggggccgtgtgcccttgaaggaggaagacctcggggaggaagcccgggtcctgggaccctcggggcacatctgcggactcgggtcccgggcccagggcgggtactcacattcacactcgcactcccactcgcgaccctcgggaagcgccaccgagaggctcccagccgccgccgcccgcccccagactctggaaacacttaggcgtccccagagcgcggcttattgtaaccagcccgagggggtccggggtgcgggccgggagcggcgtcgggcgagatgcgaatggccctgcctggcgcccctcgttcaggagcatgggcgccggcgcagcggccgggagcatagtggcggcggaagggctggccaagcgagccgtgagctaccgtctgcgcacaagccggaacgccagatcctacctgaagtccgggacactgagagcagaagcgcggcggccgcccagacggccgggatgcacagcagcggccgccgcgggagcgccgagccccgggccatgccgcaggcagtgggggccgggaagccctcagagcttcgggccggggcgcggggtcgggcgccaccacccctttctacgatgcgtccgctcctccttctccctggcgcttcgcaaacgggtccacttcgaggacctcgtcgtcgtcctcttctccggcccggatgcgccgctcggctccggccacggcaagggctggctggggaggttccttggcgcgggctggggcgtcccgccggccgccaggacgagcgcggggggcggaccgcgggcgagcgcgcaggaggcagggtccccgctcgcccgccccgatgggcagagcgaggcttgcgccggcgccccctgccgggggaacgcgcgggcggcgggcgggacccaaggagctggggctgcagctggggccccggacctgcctcctgcgcccgccctcgggcctgcgcctcggaacgcttgaacacaaaggtggcgccttgggggcgtcagccggagttcggcgggtctgcccacgcaggagaggcgcccagagcgggtgcccccgactttcgggggcgacacacccggggatctaggtcacaaatcagtaactccaggctgcactgcgcaccgggacaaatctgagagccacccagccccagacaccagcggtgaggcaggaagaggagaagcgaaagttgcaaaaggaaatgttcaggaaaacaaacaggccgccttggcaccggcgccctcccaggtcggtggggacaagcgcgtcccccgaaatgctcaaaactgccaggggtcgagctgcgtggagggagccctcgggagcgcgatgctatccgaagccaccgcggcttttggtttac

SEQ ID NO: 130782 - DNA, 30 bp, Homo sapiens; identical to SEQ ID NO: 101321
  chr9:94746198-94746228
  Hypo

SEQ ID NO: 130783 - DNA, 137 bp, Homo sapiens; identical to SEQ ID NO: 101322
  chr9:94862789-94862926
  Hypo

SEQ ID NO: 130784 - DNA, 102 bp, Homo sapiens; identical to SEQ ID NO: 101323
  chr9:94863469-94863571
  Hypo

SEQ ID NO: 130785 - DNA, 245 bp, Homo sapiens; identical to SEQ ID NO: 101324
  chr9:94934584-94934829
  Hypo

SEQ ID NO: 130786 - DNA, 30 bp, Homo sapiens; identical to SEQ ID NO: 101325
  chr9:95416325-95416355
  Hypo

SEQ ID NO: 130787 - DNA, 169 bp, Homo sapiens; identical to SEQ ID NO: 101326
  chr9:95417482-95417651
  Hypo

SEQ ID NO: 130788 - DNA, 30 bp, Homo sapiens; identical to SEQ ID NO: 101327
  chr9:95442637-95442667
  Hypo

SEQ ID NO: 130789 - DNA, 310 bp, Homo sapiens; identical to SEQ ID NO: 101328
  chr9:95485043-95485353
  Hypo

SEQ ID NO: 130790 - DNA, 30 bp, Homo sapiens; identical to SEQ ID NO: 101329
  chr9:95501326-95501356
  Hypo

SEQ ID NO: 130791 - DNA, 65 bp, Homo sapiens; identical to SEQ ID NO: 101330
  chr9:95560810-95560875
  Hypo

SEQ ID NO: 130792 - DNA, 1045 bp, Homo sapiens; identical to SEQ ID NO: 101331
  chr9:95569676-95570721
  Hyper

SEQ ID NO: 130793 - DNA, 85 bp, Homo sapiens; identical to SEQ ID NO: 101332
  chr9:95570901-95570986
  Hyper

SEQ ID NO: 130794 - DNA, 337 bp, Homo sapiens; identical to SEQ ID NO: 101333
  chr9:95571355-95571692
  Hyper

SEQ ID NO: 130795 - DNA, 516 bp, Homo sapiens; identical to SEQ ID NO: 101334
  chr9:95571752-95572268
  Hyper

SEQ ID NO: 130796 - DNA, 159 bp, Homo sapiens; identical to SEQ ID NO: 101335
  chr9:95709693-95709852
  Hyper

SEQ ID NO: 130797 - DNA, 243 bp, Homo sapiens; identical to SEQ ID NO: 101336
  chr9:95821220-95821463
  Hyper

SEQ ID NO: 130798 - DNA, 430 bp, Homo sapiens; identical to SEQ ID NO: 101337
  chr9:95946132-95946562
  Hyper

SEQ ID NO: 130799 - DNA, 30 bp, Homo sapiens; identical to SEQ ID NO: 101338
  chr9:95946829-95946859
  Hyper

SEQ ID NO: 130800 - DNA, 36 bp, Homo sapiens; identical to SEQ ID NO: 101339
  chr9:95947222-95947258
  Hyper

SEQ ID NO: 130801 - DNA, 110 bp, Homo sapiens; identical to SEQ ID NO: 101340
  chr9:96024041-96024151
  Hypo

SEQ ID NO: 130802 - DNA, 23 bp, Homo sapiens
  chr9:96230169-96230192
  Hypo
cttttttttttgagacggagttt

SEQ ID NO: 130803 - DNA, 57 bp, Homo sapiens; identical to SEQ ID NO: 101342
  chr9:96362025-96362082
  Hypo

SEQ ID NO: 130804 - DNA, 48 bp, Homo sapiens; identical to SEQ ID NO: 101343
  chr9:96436127-96436175
  Hypo

SEQ ID NO: 130805 - DNA, 28 bp, Homo sapiens
  chr9:96573710-96573738
  Hypo
tttttttttttgagacggagtctcgctc

SEQ ID NO: 130806 - DNA, 371 bp, Homo sapiens
  chr9:96588601-96588972
  Hyper
cgccgccaccattcccgttccggttggagaacacaatgcaccgcgcacaggctgtgccaaagtccacaggcacccttcggcctccatcatcgcgccctcttcacagatgagcaaacggaggccagacgtcaccggcaggcggcgctgcggtgcgcgaggcctcgcacctgcacgggaagcagcggagaggacgcaggtaaggtaaagccaggcagacccgaacctggacgcgcacctgcgggggagggggtatgcgcggggcgggttgccgcccctcccgggagtacgggcggaggcaggggcgggcgggggctttcagcagctcgtccgcggaacatttgcatgtaatttgggagcgggtcacatgtggg

SEQ ID NO: 130807 - DNA, 130 bp, Homo sapiens; identical to SEQ ID NO: 101347
  chr9:96590139-96590269
  Hyper

SEQ ID NO: 130808 - DNA, 430 bp, Homo sapiens
  chr9:96708129-96708559
  Hyper
cagctccctcggggtcgagtccctctgcgtgtcctcccctacctcggcctccacctgccccttgcacgggcggcgccgcctgccatgcgcagcacgagcctcgctaatgcgtttcgcatggcgcgtcagtcaaacgcccttctaatgtccttaaagcacgcagaaaattgcatccttatgaaaaaggagaaaaaaagcaaattgcctggtggaagcggagctgccgcgggggctggggcggcagcgcgtgcgggcggagttgcgttcggcagggcggacttggggcggctgtcaggggctctcccgggccaaggcgcaagagcaagacgctgcctcctcccagcgcttccaagtggcgcctgggcccacatccttgcctgctctctcccactcttccacctctccttgctcgttccggacaccctggcct

SEQ ID NO: 130809 - DNA, 352 bp, Homo sapiens; identical to SEQ ID NO: 101349
  chr9:96710044-96710396
  Hyper

SEQ ID NO: 130810 - DNA, 1033 bp, Homo sapiens
  chr9:96710664-96711697
  Hyper
acttgggctgggacccgcgcttcttcttttttttttttctttcttagtccccacaagtgaccctctaggggaatccagaacagggaagggagcaagccagaggaactttttttttttttaggtgaaaagccagggggagggatggggcgcccccgctcgcgactacgcctgcgactgtcctcgcgctgcgggggctgtgcgtggagcccgcggtaagctggaatatccaagccagctgcaagtggccttccgttccccacacgcctcctgcgtgctgggcccagctgggcgccgcccaaatcttctctctcccgagactctccagctccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccgcagggccacagctctcgcgagactcctgagccctctccctcccctggctgcggcccccgggctccgggaagctcagccacctgggcccacgccatatctgggtttttttcccaggactttggggatgagaagagacttgtgcatagagcggaagaggaatgggatccaagggacctttccttcaagtcccgggcctgaaatgaaggatgcgactgctgcctgcaggcagagagacaacctcagcgctcggtggctggggcgcagtggcacgcagggcgggcgccaggtagctccggtcgggcacgcgcagtccgacagactgtgtcaccttggaagacaggatgcggccctttacctagagtggcagctttgtgggctaggtcagcacggggtctccgggccggcgggcaatcgtctgcctctgcgccttagctccctg

SEQ ID NO: 130811 - DNA, 30 bp, Homo sapiens; identical to SEQ ID NO: 101352
  chr9:96711975-96712005
  Hyper

SEQ ID NO: 130812 - DNA, 30 bp, Homo sapiens; identical to SEQ ID NO: 101353
  chr9:96712723-96712753
  Hyper

SEQ ID NO: 130813 - DNA, 974 bp, Homo sapiens
  chr9:96713146-96714120
  Hyper
gcccagcctagactgcgggaaggcaactgagacctccatgagaagggggcacctgagagcacatgcaaccaagctgtgtccctgcaagggaccaccctccctaggccggtgtcagctgagtcctctctctccgtcggccaggtgccctcactgcccagaggtggaactcagcagcccaggcgccgccgccctgagtatcctgcggaaaatgtgagaactctggggagccattgctgctgcaaggacccgcgggcgggctaccgcgctggtgggggggctctgtccaaaccttgcgtcctcgacttcccatccgcctcataaagggttggtgaagaccatctcaaggaccgcacgaactggtccttcaagtcccaggaaaccgaaacaacaaccgaggcggctctctgtccgggccacttccggagcgagctctgcggcggacctctggctcccgctcctttgggcacccgcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggccgttgtggcctgagcccaaccgctgggtccccgacgtccagaagcgggtgtgtgcctggaggctccccggccgggagggcaggccc

SEQ ID NO: 130814 - DNA, 111 bp, Homo sapiens
  chr9:96714344-96714455
  Hyper
agtaaacttcttggacgcggaagggccggctcgcgggtttccgccgagtgagggggctgcgggtggcgcgggcatcccaggccccgcaccgtataccgccctcagtcctcg

SEQ ID NO: 130815 - DNA, 112 bp, Homo sapiens; identical to SEQ ID NO: 101355
  chr9:96714862-96714974
  Hyper

SEQ ID NO: 130816 - DNA, 475 bp, Homo sapiens
  chr9:96715226-96715701
  Hyper
ccatcagctgcagctcggtgaacacagtgcggctccgacgccccttcttggctttggtgcctggctccccagggcctgccgcctccagcttcccgcggagctgcaactcgagcggcaggtgtggcgcacccgcggcgccgggcagcccgggccctgccgccagcaacgcagagctcagccctgaacagcccagcggcgccagtgggaacttgaacaccgccgcctgctcggccttcagcacggctgcgaagaaagagaatgaggacccgggtgagctacggccgcgctcctctgccccagggactgccgcaccacgtgccgcgggggtgctcgcgcttggccagtgcctcccagcgcaaaacctccacgccctgccggtcggcgccggtggcgcagatggagaccctcctcaacgttgccgttccccagatttgggagggagtatctcctcgaccctgtccgtgttctgtcctgg

SEQ ID NO: 130817 - DNA, 966 bp, Homo sapiens
  chr9:96716667-96717633
  Hyper
agcaggtccgcactgcggccaaggccgcgttcctcgcccgctggagctcccggggactccgggccggcttgggcccgcgtcagcacccagccctcgggagcgcaggcctcctccccagaggtccgacttccctgggttgggcagccgcggccactcccggccatccctctgcggcgaagcccaggcgcccgtggcctgaggtcgcttccacccacgagagtccgtagcctggcagtgcgcctgcactggggatgctcactcggggtccccgggctggaggccgaagggaagcagtgaaggaaagagcgaacaccctccccgggcggcccgcgggcacgaggcctggtttctgtgaggcctggagcttgcaccctccgcctcccgcctggagggctccgagagacggtcccagaacctgcgctcccagagcagcttcccggggctgcttcgatgccggaggaggctcggggcgcccccgcggttcagctcgctgtctcccgccaagcccggcccgcgaccccgcggccgccacacgtacccaggtggctgtggaagggccgcgccgccagcagcgcctgcacgccgaacttcagcagctcgcccgccgcggcagcggcggctgcgggcgcggcgcccttgggcccgggtggctccgtgaggatctcctcaatcatgaagctgcgatagcggtgcggccggtggtccgcgcagccctcgggcgggccgaagcgcgcggcgcccggctcccccggccgctgcatcgcggcgcccactgctgcgcccgcggtttggcggcggcggcggcgacggcttggctccggcgcggggcccgcgcggggctctaggccggcccgcagctcggggcggcgcgcgggcgccggctcatgccccctcccccgccggccggccgggcggaggcgcagggcgcgggcggggcgcgcggggctcggccggtcgaacccggga

SEQ ID NO: 130818 - DNA, 408 bp, Homo sapiens; identical to SEQ ID NO: 101361
  chr9:96717848-96718256
  Hyper

SEQ ID NO: 130819 - DNA, 1200 bp, Homo sapiens
  chr9:96720841-96722041
  Hyper
ggacacaccccctcccgaggcctctagccgccgccgcgaaaatcccggaaaccgtcctgctcgcggcgggcgcagtggaaaaggtgacctcagcgccccgggccagccgccctccctagcagccgggcggcgaggggctccgggcggcaggggttcctcggcgccgcccggtcgctggatgaggggccctcggagcgcagaaccggccccctccccacccatgttctgcccctcagaccctacagcccctttggaggctgcgggacagggaggggaccacctcattcccacaaccgaatcccctaagcattcaggtgtaggttccagaaccacctcccctccacccacacccttctcctactccagcgcctcccagacgggattgtgaaatggctccgcgtgcgaacgggtccaggagccgttcgttgtacagaggaggaagctaagtctggaaggagcactcgagcaggctcagcggccagcagccagcggcagggggatcgtgcatcgcttggagggcgctgggctctcctccatccgcctcagccgtgggcagtttgtttccgctcccacttgcagcgggtctgcatcttaattggcaaaacgaagttggggccgcggtggagcggaggcttcttccagaacggtcagctcacctccggatgcggtcgtccgagcagccgcctgcggggggtcccacgccctctatctaacaggttgacgtccagcccctaggggcccaggcggccccgggccgccccacctcgcggccttctgctccccgcgcagccttgcgcgcccagccacccagcacacggtccgtccctggggacgcgtcgcgagcgccgggaatggagctcgtttcctcttttcttttttcttcttcttcttttttttttttaaacctttggttctgattgtccttggcccagcaggctgttggtggcgttggtggtgctgctgggactggggcaccggccttggccgcaggtgtgctgtgcccgacagaggccgcctggaccgcgcccggaacgccctgtccgggtgggctgcggcgttcgccctgcttttgccccgagccgagactggcaacatcttttctagcttcaaaacagaaaattttggaattataaaattaccccctccccacgcttacaggtcattatctcctggagaccaccaactcgctttctctttgga

SEQ ID NO: 130820 - DNA, 790 bp, Homo sapiens
  chr9:96722561-96723351
  Hyper
tccaggaacctgaggcgatgctcctggactcgcggagccgccagcccgccgctcccagccctccaggccctggacgggtcccgcctccatttcacacccaccgctcgccagccccggcggctcccgcagagaccttgcatccgagtccagttacgcgaaccagcggcgcctgaggccacacccagagccaggaagtagccgtctgggtgccggggctctgtgggcacggccgcgctgctgggcgcggactgcaaggccgggcggggatggtgtttgcgacccgcacaggcgctctccccccggcgagtgtggacccttcgagaatgctcccttggcccaggactgatccccacgagcatacagcttcggccttccgaggagagtcagggtcggtgcggaccgactccgcaggccctcccttgccccatctgggctggtgccaggccgcagctcgagacctggtttccaccccgggctcccacagagcccatgaagcgctggtcacagcccctggaagctgcagacccggcttttcgaggagcctccccgacgtgcagagcctgagaccccagagagcggccggctcgtgcgggccagaacgcggcgaggcgcccgcggaaacgactcggcttttctttcttttccccttttctttctttatttgcttttttttttcctctcttcccttcttccacccatttccccctcctctttcttttgtttttttttagtcctccccccacccctcttctttcttttgttgctcgttcactctcgctcttgtctcctc

SEQ ID NO: 130821 - DNA, 30 bp, Homo sapiens; identical to SEQ ID NO: 101374
  chr9:97315453-97315483
  Hypo

SEQ ID NO: 130822 - DNA, 341 bp, Homo sapiens; identical to SEQ ID NO: 101375
  chr9:97317331-97317672
  Hypo

SEQ ID NO: 130823 - DNA, 30 bp, Homo sapiens; identical to SEQ ID NO: 101377
  chr9:97369352-97369382
  Hypo

SEQ ID NO: 130824 - DNA, 88 bp, Homo sapiens; identical to SEQ ID NO: 101379
  chr9:97401378-97401466
  Hyper

SEQ ID NO: 130825 - DNA, 386 bp, Homo sapiens; identical to SEQ ID NO: 101380
  chr9:97401694-97402080
  Hyper

SEQ ID NO: 130826 - DNA, 30 bp, Homo sapiens; identical to SEQ ID NO: 101382
  chr9:97674944-97674974
  Hypo

SEQ ID NO: 130827 - DNA, 139 bp, Homo sapiens; identical to SEQ ID NO: 101383
  chr9:97679482-97679621
  Hypo

SEQ ID NO: 130828 - DNA, 30 bp, Homo sapiens; identical to SEQ ID NO: 101384
  chr9:97681851-97681881
  Hypo

SEQ ID NO: 130829 - DNA, 90 bp, Homo sapiens; identical to SEQ ID NO: 101385
  chr9:97682129-97682219
  Hypo

SEQ ID NO: 130830 - DNA, 176 bp, Homo sapiens; identical to SEQ ID NO: 101386
  chr9:97688199-97688375
  Hypo

SEQ ID NO: 130831 - DNA, 200 bp, Homo sapiens; identical to SEQ ID NO: 101389
  chr9:97807628-97807828
  Hypo

SEQ ID NO: 130832 - DNA, 30 bp, Homo sapiens; identical to SEQ ID NO: 42166
  chr9:97863868-97863898
  Hypo

SEQ ID NO: 130833 - DNA, 171 bp, Homo sapiens; identical to SEQ ID NO: 101391
  chr9:97864916-97865087
  Hypo

SEQ ID NO: 130834 - DNA, 30 bp, Homo sapiens; identical to SEQ ID NO: 101392
  chr9:97867526-97867556
  Hypo

SEQ ID NO: 130835 - DNA, 30 bp, Homo sapiens; identical to SEQ ID NO: 101393
  chr9:97887305-97887335
  Hypo

SEQ ID NO: 130836 - DNA, 62 bp, Homo sapiens; identical to SEQ ID NO: 101394
  chr9:97887619-97887681
  Hypo

SEQ ID NO: 130837 - DNA, 30 bp, Homo sapiens; identical to SEQ ID NO: 101395
  chr9:97891726-97891756
  Hypo

SEQ ID NO: 130838 - DNA, 44 bp, Homo sapiens; identical to SEQ ID NO: 101396
  chr9:98076575-98076619
  Hypo

SEQ ID NO: 130839 - DNA, 1046 bp, Homo sapiens
  chr9:98111349-98112395
  Hyper
ctaccaggacacatgcgtaacggcctgtttgcgctccctgcggttacagccgacacacgctcgcagacgcacgcacggacaccccgctttccaccagcgcacgaagacgggacgcgcgctcacagccccagggctcggccctgcaccacgagctaacgcgcggtccccagggaggtggcgcagaaggcatggcgcctctgcccacggcgtcccggtcctggtagtccctatagagaccttcgttgatggcccaggtctaaaaggctttttcctccgagcctgcgttcctccagccttcccgctgggccagggctcaccatccttcctcgccggcgagcgtgggcctccctggaggcgggggtggccctgcagaggcagccccaggtgcgcgctggagaggccggcccgccgcgcgggagacactctttccaaagtggaagcgctgcgtgggcagcagcgcgggccgggccctcggatcccagtctctgttgctcccgagacccccgccccgcgccgcatcctccgagctcagcgccctcgggctgcgctgggcgcagtggctcccggtcagggcgcagtcggcctgggcgctagagcccctctcagctcccggcctagggcggggaagcgccagctcccgcagcccctgtgaaaggtcccctgtgcctcctgcctaggtgcgcgctgtggcatctctggccagaagcacctttggcggcctgttgggcccctcgcagcctctggctgagactctgccgccggcgctaacgggctgcgcccgcgctcccgctctgtccccgcccgggtcccgggctccgcgtgcacaccactccttggccttttccaccaaaacttcctgatctccagttcgatgctgtcgtcgcggttcccggaactgctgtcttcagacggcgagccggggctgggagcggccctcacggggacggactccctccggaggcggaggtggttctcctgacgcgaaaggcaggggcgcgccccggctcccagcgccctgtttttggaaaatacgattttgtagggtg

SEQ ID NO: 130840 - DNA, 25 bp, Homo sapiens
  chr9:98196381-98196406
  Hypo
ccaccgcgcccggcctatgggctcc

SEQ ID NO: 130841 - DNA, 393 bp, Homo sapiens; identical to SEQ ID NO: 101402
  chr9:98277959-98278352
  Hyper

SEQ ID NO: 130842 - DNA, 53 bp, Homo sapiens; identical to SEQ ID NO: 101403
  chr9:98278666-98278719
  Hyper

SEQ ID NO: 130843 - DNA, 30 bp, Homo sapiens; identical to SEQ ID NO: 101404
  chr9:98279806-98279836
  Hyper

SEQ ID NO: 130844 - DNA, 30 bp, Homo sapiens; identical to SEQ ID NO: 101405
  chr9:98315417-98315447
  Hyper

SEQ ID NO: 130845 - DNA, 30 bp, Homo sapiens; identical to SEQ ID NO: 32577
  chr9:98315763-98315793
  Hyper

SEQ ID NO: 130846 - DNA, 405 bp, Homo sapiens; identical to SEQ ID NO: 101407
  chr9:98783120-98783525
  Hyper

SEQ ID NO: 130847 - DNA, 604 bp, Homo sapiens
  chr9:98783773-98784377
  Hyper
gcggcctgggggacacggggcaaattctcggatagcgacgggcaggaaggggacccgggctggcgatgggccgagtgcctcctttgctctcacccccgcgcgaagacgaggccagtgggcgggtggcgtggggcgaggcctccgcaggccgccgggggcccaggcacctggagccgggagggtccgctcccttccccgccctggatggcggcctatgggaaagcagtctccactggatcccgcgcgcgtcgcgccgaggtcgtgggaaaccgagggcgggagggcgggagggcggaggcgccggcagggtcggcgggactggggctcggacggaggacaggggcgaggaggaggcaggaaggacgccgggtactgcggggcgcctagggggttccgagcgcagcggctgcggggccgacccgcccaggatggaatcagggccccggcgcccccacgccgctcctccaggccgaacccctgcggccccaatcccccggcctcacgcccaccccgcaggtcggccctgcagctgccttcccttcctccacctccctcccgcctccgaagccggcgcccccggccaagtggccgctctcaacctgtt

SEQ ID NO: 130848 - DNA, 155 bp, Homo sapiens; identical to SEQ ID NO: 101410
  chr9:98784772-98784927
  Hyper

SEQ ID NO: 130849 - DNA, 551 bp, Homo sapiens
  chr9:98789547-98790098
  Hyper
gtgtgctctagttcccggcaaagcaggtgggagacggagtgaccggcaggacaggctgcctggggaaccgggaaggctgaagtggacacaggaggagctggcagggagagcccaggccccgcgggctgcgggaaaggagagggcagcgactgggcgagggaggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccccggccgctctttctcagcattcttcgcagcttcatctccatccgcgccgccttgccgagaccctccaagccgactcctcagcctt

SEQ ID NO: 130850 - DNA, 20 bp, Homo sapiens
  chr9:98793021-98793041
  Hypo
aggtacgtggctccagcgac

SEQ ID NO: 130851 - DNA, 30 bp, Homo sapiens; identical to SEQ ID NO: 101414
  chr9:99189069-99189099
  Hypo

SEQ ID NO: 130852 - DNA, 84 bp, Homo sapiens; identical to SEQ ID NO: 101415
  chr9:99380993-99381077
  Hyper

SEQ ID NO: 130853 - DNA, 177 bp, Homo sapiens; identical to SEQ ID NO: 101416
  chr9:99381503-99381680
  Hyper

SEQ ID NO: 130854 - DNA, 303 bp, Homo sapiens; identical to SEQ ID NO: 101417
  chr9:99449095-99449398
  Hyper

SEQ ID NO: 130855 - DNA, 179 bp, Homo sapiens; identical to SEQ ID NO: 101418
  chr9:99487982-99488161
  Hypo

SEQ ID NO: 130856 - DNA, 41 bp, Homo sapiens; identical to SEQ ID NO: 101419
  chr9:99539965-99540006
  Hyper

SEQ ID NO: 130857 - DNA, 518 bp, Homo sapiens; identical to SEQ ID NO: 101420
  chr9:99639574-99640092
  Hyper

SEQ ID NO: 130858 - DNA, 564 bp, Homo sapiens; identical to SEQ ID NO: 101422
  chr9:99983140-99983704
  Hyper

SEQ ID NO: 130859 - DNA, 240 bp, Homo sapiens; identical to SEQ ID NO: 101423
  chr9:99983764-99984004
  Hyper

SEQ ID NO: 130860 - DNA, 132 bp, Homo sapiens; identical to SEQ ID NO: 100071
  chr9:100000368-100000500
  Hyper

SEQ ID NO: 130861 - DNA, 355 bp, Homo sapiens; identical to SEQ ID NO: 100072
  chr9:100000739-100001094
  Hyper

SEQ ID NO: 130862 - DNA, 172 bp, Homo sapiens; identical to SEQ ID NO: 100073
  chr9:100264699-100264871
  Hyper

SEQ ID NO: 130863 - DNA, 39 bp, Homo sapiens; identical to SEQ ID NO: 100074
  chr9:100267685-100267724
  Hypo

SEQ ID NO: 130864 - DNA, 30 bp, Homo sapiens; identical to SEQ ID NO: 100075
  chr9:100278507-100278537
  Hypo

SEQ ID NO: 130865 - DNA, 77 bp, Homo sapiens; identical to SEQ ID NO: 100076
  chr9:100349303-100349380
  Hypo

SEQ ID NO: 130866 - DNA, 317 bp, Homo sapiens; identical to SEQ ID NO: 42169
  chr9:100397395-100397712
  Hypo

SEQ ID NO: 130867 - DNA, 151 bp, Homo sapiens; identical to SEQ ID NO: 100078
  chr9:100457244-100457395
  Hypo

SEQ ID NO: 130868 - DNA, 527 bp, Homo sapiens; identical to SEQ ID NO: 100079
  chr9:100503433-100503960
  Hyper

SEQ ID NO: 130869 - DNA, 422 bp, Homo sapiens
  chr9:100610058-100610480
  Hyper
tgggcaactggaacccggctggagtgtgcagctggccccctcacttccagcccgcaggctgccgcgggggtgactcccgggagatgcgcctagagaggcaggacacctgcacgcatattcgtaacagaggcagaaatactgacggcgaaacctagagagacttgcactccaggcccggggggtgggggggcgggggagaagccttagggagagtggggaggaggccagaggagagctggctgctctctcgtgttgaggttcaagtgtcttccagctccccgcgccccctcctcaccgtgccaccgcccacctcatgctttgggcgccaagcagccaagcaaccgggttgcgttgtagggggaggcaatcagccctgttacccctcctcaggcggccggactgagctgcgggatgggatccct

SEQ ID NO: 130870 - DNA, 982 bp, Homo sapiens
  chr9:100610681-100611663
  Hyper
caagtgttccaaagccgcgcacaaatttcggaaccagaccaagaatcctggactctagacgttgcctgggggccgatcctgcgcccagggtcccagaatctaactgaaatgcgcctgcgggccgccaccttcgccccgggccacggctttgccaggaatgcccgccgccacagctgaactcccgcccgcccgcctgggtcggatcagacgcgggtagtggcttgcgcttcgtggtcctcgggtccggaacgcagggaaagcgcgtggagccaacctagagcgggagcagggtctggcttgactctgtccccgattcgttgtgcgcagtgggacaagtccgcgccgtccggagccgacttccccttctcgttgtggccgtaaagctgctggacctccaagccggctcctgcgctccccgctgctctgagaacactgagtgtcccgggcccgcgcagactgggttgggagagggctctgtgggagggcttgcggggagcggggtaagaaaggctaggtgcttcttacctacgtaagaaacgttggtggcgggatctaagcaaacggggaggtgggaagcagaaggttccccttcctgggccccagttcctccatcctgtcccctgggtgacagtgattcgctgttcatagtgtttaagtggaccaacttaaagggagagagcgcttgccgagctctgggaaaccgaaagggtccacgcccgcgggagcctcggagactcaaaatcccccgctagaccgcagaaaatgttacactttaatcaaccgctacttcttccgtggagaggggcggtgggtgggggtgtgcgcatctcatcgcggcctgtgagtggaacaggctagaattatccccagcgtcttttttccatgtccaagtttcgccttaaaacaatttaaaagaggaagaagaggaccgcgcgtctgtaaggcgctccactttatcaccttgactcggtggaagagaaag

SEQ ID NO: 130871 - DNA, 4368 bp, Homo sapiens
  chr9:100613687-100618055
  Hyper
cgttaggacaacggtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttactggccagaactctcgtcttgggatctcccacactcacctggcaccaccatccgcgcggctctgcacccacagccccggcccgccccccccccccaccccggaaagctgcgtccgggctggagccactggaacccgcgccaaggcccggaatcctatacgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccgcagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccccattcccacaaaaaccaagcgccctctcggccaattctcaccctctcaggacaaaaaagtgagatgagcccgtcctttcacctgcgagtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgtgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaa

SEQ ID NO: 130872 - DNA, 1163 bp, Homo sapiens; identical to SEQ ID NO: 32603
  chr9:100619620-100620783
  Hyper

SEQ ID NO: 130873 - DNA, 17 bp, Homo sapiens
  chr9:100735117-100735134
  Hypo
tgcggcactgcactcca

SEQ ID NO: 130874 - DNA, 30 bp, Homo sapiens; identical to SEQ ID NO: 100092
  chr9:100797208-100797238
  Hyper

SEQ ID NO: 130875 - DNA, 52 bp, Homo sapiens; identical to SEQ ID NO: 100093
  chr9:100817046-100817098
  Hypo

SEQ ID NO: 130876 - DNA, 143 bp, Homo sapiens; identical to SEQ ID NO: 100094
  chr9:100818294-100818437
  Hypo

SEQ ID NO: 130877 - DNA, 21 bp, Homo sapiens
  chr9:100835849-100835870
  Hypo
ccaccgcgcctggcctgggct

SEQ ID NO: 130878 - DNA, 124 bp, Homo sapiens; identical to SEQ ID NO: 100096
  chr9:100843289-100843413
  Hypo

SEQ ID NO: 130879 - DNA, 176 bp, Homo sapiens; identical to SEQ ID NO: 100097
  chr9:100935510-100935686
  Hypo

SEQ ID NO: 130880 - DNA, 30 bp, Homo sapiens; identical to SEQ ID NO: 42172
  chr9:100981193-100981223
  Hypo

SEQ ID NO: 130881 - DNA, 94 bp, Homo sapiens; identical to SEQ ID NO: 42173
  chr9:100981840-100981934
  Hypo

SEQ ID NO: 130882 - DNA, 30 bp, Homo sapiens; identical to SEQ ID NO: 100100
  chr9:101016284-101016314
  Hypo

SEQ ID NO: 130883 - DNA, 38 bp, Homo sapiens; identical to SEQ ID NO: 100101
  chr9:101216438-101216476
  Hypo

SEQ ID NO: 130884 - DNA, 1179 bp, Homo sapiens; identical to SEQ ID NO: 100102
  chr9:101469181-101470360
  Hyper

SEQ ID NO: 130885 - DNA, 1346 bp, Homo sapiens
  chr9:101470607-101471953
  Hyper
gatctgaccaaaggccggaggttgcctgtgtccaaaccacccaccccaatgccccccgaagccccgacggcaggggcagccggacactcacctccgtgtcatagagccgcaggtcgaggaagtaggggcgcaggagtgactcgttgcggatctgctcgatggccagttccacggcggggagcacaccgcgcccgatgctgcccttggccacctccttggtgagcggcatgaggcccatgatggagagcggcgggctgctgggcggcggccggggggcgccccgcgcccagccccaggccccgggcgccagaggcagcagcagcggcagcagcagtagcagtagcaggcgcgcgggcggcggtggcggcggcggcggcggcccgggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgcggggagggccaccttcccagcacacgcacacacgcgcccccggccctccgctgcgccagctgccgctgcccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgcccacgagcccctgaccgagtcccgggggtcgctgaagacgcccacgggtgctcgaacgcccgttggtgccaggctgcccggcctttagggcct

SEQ ID NO: 130886 - DNA, 30 bp, Homo sapiens; identical to SEQ ID NO: 42174
  chr9:101557939-101557969
  Hypo

SEQ ID NO: 130887 - DNA, 49 bp, Homo sapiens; identical to SEQ ID NO: 100106
  chr9:101559178-101559227
  Hyper

SEQ ID NO: 130888 - DNA, 1028 bp, Homo sapiens
  chr9:101705868-101706896
  Hyper
agaggattccctcagcggctgtgaaagagtgctttcttgcgggtcagccccgacaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagctgggtgcggagcctccaatcttaggcagagagggacttcagaaacagcgccagcgccagcgccaacagcctcagcgcacccagcgccagcagcttaggttgtgcgtgctggctggctt

SEQ ID NO: 130889 - DNA, 30 bp, Homo sapiens; identical to SEQ ID NO: 100110
  chr9:101734127-101734157
  Hypo

SEQ ID NO: 130890 - DNA, 30 bp, Homo sapiens; identical to SEQ ID NO: 100111
  chr9:101924520-101924550
  Hypo

SEQ ID NO: 130891 - DNA, 19 bp, Homo sapiens
  chr9:101982656-101982675
  Hypo
tacataagaatgtcccggc

SEQ ID NO: 130892 - DNA, 40 bp, Homo sapiens; identical to SEQ ID NO: 100113
  chr9:102107331-102107371
  Hypo

SEQ ID NO: 130893 - DNA, 30 bp, Homo sapiens; identical to SEQ ID NO: 100114
  chr9:102186087-102186117
  Hypo

SEQ ID NO: 130894 - DNA, 28 bp, Homo sapiens
  chr9:102203901-102203929
  Hypo
gcatgagccactgcgcccagcctattcc

SEQ ID NO: 130895 - DNA, 341 bp, Homo sapiens; identical to SEQ ID NO: 100116
  chr9:102586644-102586985
  Hyper

SEQ ID NO: 130896 - DNA, 37 bp, Homo sapiens; identical to SEQ ID NO: 15233
  chr9:103174717-103174754
  Hypo

SEQ ID NO: 130897 - DNA, 87 bp, Homo sapiens; identical to SEQ ID NO: 100118
  chr9:103176794-103176881
  Hypo

SEQ ID NO: 130898 - DNA, 722 bp, Homo sapiens
  chr9:103235208-103235930
  Hyper
caaacaagtctgctacggtgcagcctaccgccgaggggtggccccaaccccggcccccgcgcccctgccctgtcgcaggaacaatagctcccctggaggcggcgccggccgcggccgggggcggagctgtcggcgcgggagctgggggtgtgcgcggggcggggtcgcagccacccctcccgccggcggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcc

SEQ ID NO: 130899 - DNA, 42 bp, Homo sapiens; identical to SEQ ID NO: 100121
  chr9:103236598-103236640
  Hyper

SEQ ID NO: 130900 - DNA, 137 bp, Homo sapiens; identical to SEQ ID NO: 32616
  chr9:103790552-103790689
  Hyper

SEQ ID NO: 130901 - DNA, 55 bp, Homo sapiens; identical to SEQ ID NO: 100123
  chr9:103790962-103791017
  Hyper

SEQ ID NO: 130902 - DNA, 484 bp, Homo sapiens; identical to SEQ ID NO: 100124
  chr9:103791220-103791704
  Hyper

SEQ ID NO: 130903 - DNA, 151 bp, Homo sapiens; identical to SEQ ID NO: 100125
  chr9:103791929-103792080
  Hyper

SEQ ID NO: 130904 - DNA, 332 bp, Homo sapiens; identical to SEQ ID NO: 100127
  chr9:104248291-104248623
  Hyper

SEQ ID NO: 130905 - DNA, 130 bp, Homo sapiens; identical to SEQ ID NO: 100128
  chr9:104248845-104248975
  Hyper

SEQ ID NO: 130906 - DNA, 75 bp, Homo sapiens; identical to SEQ ID NO: 100129
  chr9:104249474-104249549
  Hyper

SEQ ID NO: 130907 - DNA, 1302 bp, Homo sapiens
  chr9:104499922-104501224
  Hyper
gggcttacgggagcccggcggcccccggccatgcagggtgctccccaaccagcgtgcgcccggcgagggcgccggggaccgcctagtccctggctccggctcatccctctgggctcctgctcggctgtcgtccggagcgcggctggccgcgcggggggcggtggtccagggctgcaagtgcaccgcgcccaccctcaccgcgtgcccgatgcgcttgaggatctggcagggctgcgggtgcgaggaggagctgggcaccccggccagcaccagtgcgcagggcggcggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaagcagccggagttcctcgggggcagcagtgacagaggagcgacgcgctctcgcctggattcttttccttttctgcccaggcgagacccacttatttcctggggtcgcgttggagagggctttcacgcccggggtgcggaaaagaagccaaatccaccttcctccactgttggccaccctcctgcaggctcccccagcgccgacttcattttctctcttctctcgctacttcctctctgcctttctttcgttatttttccaccgagtcgccaccgccgcttgcttcctcggaggagcaacgcgactggccagcaaagggtggctctgctccgagcgccaaagttctccccgcctcagccggcgcctccctgttgctgagccctggcgcctgcctgtcgcttggctgcgctaaacgcccactgttggtgagattcccgagtggcacatcccgcgcccctggaaagtcctctcccctcaaaggctgggcgtcatagtttgcaaaattccctaaaacctaagaaggaaaataggactatgagccggtgagaattctgaattcagagtcgcacctgagggatctgaaattcggtggttcactgaa

SEQ ID NO: 130908 - DNA, 19 bp, Homo sapiens
  chr9:105418502-105418521
  Hypo
ttatttattttgagacgga

SEQ ID NO: 130909 - DNA, 196 bp, Homo sapiens; identical to SEQ ID NO: 42179
  chr9:107221358-107221554
  Hypo

SEQ ID NO: 130910 - DNA, 108 bp, Homo sapiens; identical to SEQ ID NO: 100140
  chr9:107396386-107396494
  Hypo

SEQ ID NO: 130911 - DNA, 30 bp, Homo sapiens; identical to SEQ ID NO: 100141
  chr9:107526267-107526297
  Hyper

SEQ ID NO: 130912 - DNA, 332 bp, Homo sapiens; identical to SEQ ID NO: 100142
  chr9:107730465-107730797
  Hyper

SEQ ID NO: 130913 - DNA, 476 bp, Homo sapiens; identical to SEQ ID NO: 32627
  chr9:108418471-108418947
  Hyper

SEQ ID NO: 130914 - DNA, 30 bp, Homo sapiens; identical to SEQ ID NO: 100144
  chr9:109012750-109012780
  Hypo

SEQ ID NO: 130915 - DNA, 607 bp, Homo sapiens; identical to SEQ ID NO: 100145
  chr9:109622609-109623216
  Hyper

SEQ ID NO: 130916 - DNA, 194 bp, Homo sapiens; identical to SEQ ID NO: 100146
  chr9:109623464-109623658
  Hyper

SEQ ID NO: 130917 - DNA, 102 bp, Homo sapiens; identical to SEQ ID NO: 100147
  chr9:109624462-109624564
  Hyper

SEQ ID NO: 130918 - DNA, 30 bp, Homo sapiens; identical to SEQ ID NO: 100148
  chr9:110126233-110126263
  Hypo

SEQ ID NO: 130919 - DNA, 847 bp, Homo sapiens; identical to SEQ ID NO: 100149
  chr9:110227815-110228662
  Hyper

SEQ ID NO: 130920 - DNA, 30 bp, Homo sapiens; identical to SEQ ID NO: 100150
  chr9:110251099-110251129
  Hyper

SEQ ID NO: 130921 - DNA, 616 bp, Homo sapiens; identical to SEQ ID NO: 100151
  chr9:110251462-110252078
  Hyper

SEQ ID NO: 130922 - DNA, 74 bp, Homo sapiens; identical to SEQ ID NO: 100152
  chr9:110252298-110252372
  Hyper

SEQ ID NO: 130923 - DNA, 67 bp, Homo sapiens; identical to SEQ ID NO: 100153
  chr9:110252633-110252700
  Hyper

SEQ ID NO: 130924 - DNA, 223 bp, Homo sapiens; identical to SEQ ID NO: 100154
  chr9:110253522-110253745
  Hyper

SEQ ID NO: 130925 - DNA, 627 bp, Homo sapiens; identical to SEQ ID NO: 100155
  chr9:110399878-110400505
  Hyper

SEQ ID NO: 130926 - DNA, 464 bp, Homo sapiens
  chr9:111929136-111929600
  Hyper
cccggtctcccctcccgcaacccctcgccctcccgcagcctcaccctcctccgacaggtagcgcaggtcgtagaactcccccgcgaaggtgccgtaggaggagtcgtggcgcggcaccgcctcgtcggcgcccgtgtccccccgcgcgcgtccccggggtccccggccccccgggcccgcaccgtcgtccgcggggctggctgcgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctcggtctgcgcatcctcgctccagcaccgcagcctccccctt

SEQ ID NO: 130927 - DNA, 80 bp, Homo sapiens; identical to SEQ ID NO: 32639
  chr9:112081693-112081773
  Hyper

SEQ ID NO: 130928 - DNA, 427 bp, Homo sapiens; identical to SEQ ID NO: 100161
  chr9:112259825-112260252
  Hyper

SEQ ID NO: 130929 - DNA, 55 bp, Homo sapiens; identical to SEQ ID NO: 100162
  chr9:112260468-112260523
  Hyper

SEQ ID NO: 130930 - DNA, 54 bp, Homo sapiens; identical to SEQ ID NO: 100163
  chr9:112261948-112262002
  Hyper

SEQ ID NO: 130931 - DNA, 988 bp, Homo sapiens
  chr9:112402499-112403487
  Hyper
aacgccgcattaaggcgcttcaagatagctggagttttgcttgggaaactcagagggatctcgcccggccggcacaatggcgtttctgaacccatgcccagcccactgggggcagtccttgctgcttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgcggcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgac

SEQ ID NO: 130932 - DNA, 688 bp, Homo sapiens; identical to SEQ ID NO: 100166
  chr9:112542235-112542923
  Hyper

SEQ ID NO: 130933 - DNA, 30 bp, Homo sapiens; identical to SEQ ID NO: 100167
  chr9:112806909-112806939
  Hypo

SEQ ID NO: 130934 - DNA, 1265 bp, Homo sapiens
  chr9:113341075-113342340
  Hyper
tgacatccctctaagcgttttaaaatccattatcccattggaacctccacaacaataataggcgggtagcgatgactctggttttgtggatggggacgcttgacttggggtggttatgccttgcccaggactgaaccccgggatagagacgggcaggcagcggtgggtcgaagggcccggggactagggcccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaacgcctggcccagccgctccactctgctccccgccgcttcgtcgccaggagcgggcggcgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcgcggggcagcggccaagagcctcagcgccctttcatctgacactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaacattcccgcagcaagcgcaccagcgccgaagccctgattga

SEQ ID NO: 130935 - DNA, 18 bp, Homo sapiens
  chr9:113366336-113366354
  Hypo
gcccggtcataattccct

SEQ ID NO: 130936 - DNA, 30 bp, Homo sapiens; identical to SEQ ID NO: 100174
  chr9:113689346-113689376
  Hypo

SEQ ID NO: 130937 - DNA, 397 bp, Homo sapiens; identical to SEQ ID NO: 100175
  chr9:113800084-113800481
  Hyper

SEQ ID NO: 130938 - DNA, 30 bp, Homo sapiens; identical to SEQ ID NO: 100176
  chr9:113800768-113800798
  Hyper

SEQ ID NO: 130939 - DNA, 334 bp, Homo sapiens; identical to SEQ ID NO: 100177
  chr9:113801080-113801414
  Hyper

SEQ ID NO: 130940 - DNA, 199 bp, Homo sapiens; identical to SEQ ID NO: 100178
  chr9:114287440-114287639
  Hyper

SEQ ID NO: 130941 - DNA, 138 bp, Homo sapiens; identical to SEQ ID NO: 32651
  chr9:114287962-114288100
  Hyper

SEQ ID NO: 130942 - DNA, 261 bp, Homo sapiens; identical to SEQ ID NO: 100180
  chr9:114361183-114361444
  Hyper

SEQ ID NO: 130943 - DNA, 30 bp, Homo sapiens; identical to SEQ ID NO: 32652
  chr9:114361785-114361815
  Hyper

SEQ ID NO: 130944 - DNA, 41 bp, Homo sapiens; identical to SEQ ID NO: 100182
  chr9:114362053-114362094
  Hyper

SEQ ID NO: 130945 - DNA, 87 bp, Homo sapiens; identical to SEQ ID NO: 100183
  chr9:114631024-114631111
  Hypo

SEQ ID NO: 130946 - DNA, 26 bp, Homo sapiens
  chr9:114631171-114631197
  Hypo
acaatgaatcgcgggtatttatccca

SEQ ID NO: 130947 - DNA, 88 bp, Homo sapiens; identical to SEQ ID NO: 100185
  chr9:114710299-114710387
  Hypo

SEQ ID NO: 130948 - DNA, 32 bp, Homo sapiens; identical to SEQ ID NO: 100187
  chr9:114784817-114784849
  Hypo

SEQ ID NO: 130949 - DNA, 146 bp, Homo sapiens; identical to SEQ ID NO: 100188
  chr9:114931839-114931985
  Hypo

SEQ ID NO: 130950 - DNA, 19 bp, Homo sapiens
  chr9:115067926-115067945
  Hypo
ataagagctttcagccggg

SEQ ID NO: 130951 - DNA, 79 bp, Homo sapiens; identical to SEQ ID NO: 100190
  chr9:115068245-115068324
  Hypo

SEQ ID NO: 130952 - DNA, 30 bp, Homo sapiens; identical to SEQ ID NO: 42183
  chr9:115087309-115087339
  Hypo

SEQ ID NO: 130953 - DNA, 120 bp, Homo sapiens; identical to SEQ ID NO: 100192
  chr9:115087595-115087715
  Hypo

SEQ ID NO: 130954 - DNA, 146 bp, Homo sapiens; identical to SEQ ID NO: 42185
  chr9:115172301-115172447
  Hypo

SEQ ID NO: 130955 - DNA, 30 bp, Homo sapiens; identical to SEQ ID NO: 100194
  chr9:115202051-115202081
  Hypo

SEQ ID NO: 130956 - DNA, 39 bp, Homo sapiens; identical to SEQ ID NO: 100195
  chr9:115478932-115478971
  Hypo

SEQ ID NO: 130957 - DNA, 30 bp, Homo sapiens; identical to SEQ ID NO: 42187
  chr9:115599305-115599335
  Hypo

SEQ ID NO: 130958 - DNA, 635 bp, Homo sapiens; identical to SEQ ID NO: 100197
  chr9:115652922-115653557
  Hyper

SEQ ID NO: 130959 - DNA, 30 bp, Homo sapiens; identical to SEQ ID NO: 42188
  chr9:115773781-115773811
  Hypo

SEQ ID NO: 130960 - DNA, 37 bp, Homo sapiens; identical to SEQ ID NO: 100199
  chr9:115774571-115774608
  Hyper

SEQ ID NO: 130961 - DNA, 53 bp, Homo sapiens; identical to SEQ ID NO: 100200
  chr9:115818864-115818917
  Hyper

SEQ ID NO: 130962 - DNA, 63 bp, Homo sapiens; identical to SEQ ID NO: 100201
  chr9:115913757-115913820
  Hyper

SEQ ID NO: 130963 - DNA, 40 bp, Homo sapiens; identical to SEQ ID NO: 100202
  chr9:116028536-116028576
  Hypo

SEQ ID NO: 130964 - DNA, 30 bp, Homo sapiens; identical to SEQ ID NO: 100203
  chr9:116060098-116060128
  Hypo

SEQ ID NO: 130965 - DNA, 37 bp, Homo sapiens; identical to SEQ ID NO: 100204
  chr9:116065790-116065827
  Hypo

SEQ ID NO: 130966 - DNA, 87 bp, Homo sapiens; identical to SEQ ID NO: 100205
  chr9:116128876-116128963
  Hypo

SEQ ID NO: 130967 - DNA, 30 bp, Homo sapiens; identical to SEQ ID NO: 100206
  chr9:116270970-116271000
  Hypo

SEQ ID NO: 130968 - DNA, 109 bp, Homo sapiens; identical to SEQ ID NO: 100207
  chr9:116331277-116331386
  Hypo

SEQ ID NO: 130969 - DNA, 159 bp, Homo sapiens
  chr9:116450308-116450467
  Hyper
ggtcaggggagggagcgggcgatctcaccctgcagcccgcacactcaggcctacactccccggtttggagcccagataaccccttcccgtcctcccctcacccgcgggaaccctggagagccggtaggggaggttcgcaccctgcgttgcagctgcctt

SEQ ID NO: 130970 - DNA, 137 bp, Homo sapiens; identical to SEQ ID NO: 100209
  chr9:116542589-116542726
  Hypo

SEQ ID NO: 130971 - DNA, 80 bp, Homo sapiens; identical to SEQ ID NO: 100210
  chr9:116633829-116633909
  Hypo

SEQ ID NO: 130972 - DNA, 19 bp, Homo sapiens
  chr9:116634089-116634108
  Hypo
tcaccgtgttagccaggat

SEQ ID NO: 130973 - DNA, 186 bp, Homo sapiens; identical to SEQ ID NO: 100212
  chr9:116756509-116756695
  Hyper

SEQ ID NO: 130974 - DNA, 41 bp, Homo sapiens; identical to SEQ ID NO: 100213
  chr9:116800689-116800730
  Hypo

SEQ ID NO: 130975 - DNA, 221 bp, Homo sapiens; identical to SEQ ID NO: 100214
  chr9:116916349-116916570
  Hyper

SEQ ID NO: 130976 - DNA, 86 bp, Homo sapiens; identical to SEQ ID NO: 100215
  chr9:116916917-116917003
  Hyper

SEQ ID NO: 130977 - DNA, 30 bp, Homo sapiens; identical to SEQ ID NO: 100216
  chr9:116917360-116917390
  Hyper

SEQ ID NO: 130978 - DNA, 126 bp, Homo sapiens; identical to SEQ ID NO: 100217
  chr9:116918762-116918888
  Hyper

SEQ ID NO: 130979 - DNA, 49 bp, Homo sapiens; identical to SEQ ID NO: 100218
  chr9:117050981-117051030
  Hypo

SEQ ID NO: 130980 - DNA, 141 bp, Homo sapiens; identical to SEQ ID NO: 100219
  chr9:117267155-117267296
  Hyper

SEQ ID NO: 130981 - DNA, 82 bp, Homo sapiens; identical to SEQ ID NO: 100222
  chr9:117880343-117880425
  Hyper

SEQ ID NO: 130982 - DNA, 753 bp, Homo sapiens; identical to SEQ ID NO: 100223
  chr9:118916326-118917079
  Hyper

SEQ ID NO: 130983 - DNA, 472 bp, Homo sapiens; identical to SEQ ID NO: 100224
  chr9:118917306-118917778
  Hyper

SEQ ID NO: 130984 - DNA, 198 bp, Homo sapiens; identical to SEQ ID NO: 100225
  chr9:118919150-118919348
  Hyper

SEQ ID NO: 130985 - DNA, 30 bp, Homo sapiens; identical to SEQ ID NO: 100226
  chr9:118950279-118950309
  Hypo

SEQ ID NO: 130986 - DNA, 1085 bp, Homo sapiens; identical to SEQ ID NO: 100227
  chr9:120175273-120176358
  Hyper

SEQ ID NO: 130987 - DNA, 863 bp, Homo sapiens; identical to SEQ ID NO: 100228
  chr9:120176694-120177557
  Hyper

SEQ ID NO: 130988 - DNA, 140 bp, Homo sapiens; identical to SEQ ID NO: 32665
  chr9:120177898-120178038
  Hyper

SEQ ID NO: 130989 - DNA, 34 bp, Homo sapiens; identical to SEQ ID NO: 100230
  chr9:120315798-120315832
  Hypo

SEQ ID NO: 130990 - DNA, 155 bp, Homo sapiens
  chr9:120507292-120507447
  Hyper
gagcgcccgcgccttcgcgggctgcgcggggctcagggagccgcggccacggctcccgcgcgctcgctcgcccgcaggatctgggcagccccgcggggacccggctctgcgcgcagcccattgtacagctggcgcagccgcgcaaatgacatctg

SEQ ID NO: 130991 - DNA, 37 bp, Homo sapiens; identical to SEQ ID NO: 100232
  chr9:121930100-121930137
  Hypo

SEQ ID NO: 130992 - DNA, 30 bp, Homo sapiens; identical to SEQ ID NO: 100233
  chr9:122130678-122130708
  Hyper

SEQ ID NO: 130993 - DNA, 1254 bp, Homo sapiens
  chr9:122130973-122132227
  Hyper
cctcccttacacacacggacacacacacacaccacgaacacacgcatcaaacgcaaacgacgccgcacacgcaaacacactagcaccacatcaagttcccaccatggtgcacacgtcgggagcgcgcggggacacacacgccactcactcaaacccgcaattagccctttgagccccaggcacaggaaccccctccctagaactggagaagacttggaggcggcggggcggccaggtgaagagcggacaagggtgccggtagggggaggggcagaggagcgcggggacgccccgaatgcggcccggggccgggtccaagggcagcggggctgcggggcgctgcacccggcgccgccttacctggagtcaatgtccgtctttggcggagagctgcgggaggacgctttttattcggctcggtgggaacttgggagagccctgcgtgcagctcgcattccgggcacggcgcggggactgcaggcgtgggggtacctggctcctagcagcctggctcatactcagccgtaaagtccccttcgctggtcccgaggacaggcatgaatcccggctccggaaggcggtcactactccctctgcctcccggctctctcgctctcgctctcgctgttgctcgctcgctctctccctctctcgcgggttcgctcgcctgcgctctcctcctccccgcgcgccagatcagtttgcagccgtggggtccgggagcgaggcggctggcgaatggagagggaagtccaagtgcgccgcggtctccgggcggggagcggcggaggccgggctacgccgggggagggacttagccggcgacggccgaaaatgaatgggggagcggcggccggggggcggggagggaggagctgaacgccggggttgcttccgaggagtgttttgtacatctttaggcggaggaggaggagaagcgagaggaggagagacgggaggccgcctcgagggaagggcggcccgggtgggctggggctgagccgtagggagtttcgtgggtctggggcgtgtagggtgttgtgtctatgcgcacgagcatccaaagggaccgcgcatacgcgcaaacccggaatcctggtgcccttaagcgtgactgtactgtgtgtgtcgcgagtacctgagtgtttctggggcggcaggtgtttccacggccgcgtggatccatcgagtgtgggttttgtctcgggagttgcccgtgtgggtccgtttgtgtctgcgcgtctctctgtgagt

SEQ ID NO: 130994 - DNA, 232 bp, Homo sapiens; identical to SEQ ID NO: 100237
  chr9:123150500-123150732
  Hypo

SEQ ID NO: 130995 - DNA, 30 bp, Homo sapiens; identical to SEQ ID NO: 42195
  chr9:123272513-123272543
  Hypo

SEQ ID NO: 130996 - DNA, 79 bp, Homo sapiens; identical to SEQ ID NO: 100239
  chr9:123287834-123287913
  Hypo

SEQ ID NO: 130997 - DNA, 30 bp, Homo sapiens; identical to SEQ ID NO: 42197
  chr9:123294978-123295008
  Hypo

SEQ ID NO: 130998 - DNA, 53 bp, Homo sapiens; identical to SEQ ID NO: 100241
  chr9:123295496-123295549
  Hypo

SEQ ID NO: 130999 - DNA, 30 bp, Homo sapiens; identical to SEQ ID NO: 100242
  chr9:123642193-123642223
  Hypo

SEQ ID NO: 131000 - DNA, 35 bp, Homo sapiens; identical to SEQ ID NO: 100243
  chr9:123690879-123690914
  Hyper

SEQ ID NO: 131001 - DNA, 40 bp, Homo sapiens; identical to SEQ ID NO: 100244
  chr9:124061944-124061984
  Hyper

SEQ ID NO: 131002 - DNA, 71 bp, Homo sapiens; identical to SEQ ID NO: 100245
  chr9:124261319-124261390
  Hyper

SEQ ID NO: 131003 - DNA, 137 bp, Homo sapiens; identical to SEQ ID NO: 100246
  chr9:124262375-124262512
  Hyper

SEQ ID NO: 131004 - DNA, 541 bp, Homo sapiens; identical to SEQ ID NO: 100247
  chr9:124361389-124361930
  Hyper

SEQ ID NO: 131005 - DNA, 141 bp, Homo sapiens; identical to SEQ ID NO: 100248
  chr9:124362183-124362324
  Hyper

SEQ ID NO: 131006 - DNA, 159 bp, Homo sapiens; identical to SEQ ID NO: 100249
  chr9:124461151-124461310
  Hyper

SEQ ID NO: 131007 - DNA, 30 bp, Homo sapiens; identical to SEQ ID NO: 100250
  chr9:124499696-124499726
  Hypo

SEQ ID NO: 131008 - DNA, 30 bp, Homo sapiens; identical to SEQ ID NO: 100251
  chr9:124500396-124500426
  Hypo

SEQ ID NO: 131009 - DNA, 30 bp, Homo sapiens; identical to SEQ ID NO: 100252
  chr9:124580756-124580786
  Hypo

SEQ ID NO: 131010 - DNA, 125 bp, Homo sapiens; identical to SEQ ID NO: 100253
  chr9:124751390-124751515
  Hypo

SEQ ID NO: 131011 - DNA, 51 bp, Homo sapiens
  chr9:124981737-124981788
  Hyper
cagcctactccccctcgaagagccgaccccgggttccgccacccggctggt

SEQ ID NO: 131012 - DNA, 492 bp, Homo sapiens
  chr9:124990520-124991012
  Hyper
aagagaaaagagaggcgctcaaggggaggaaaaagcaccctccagcccctcggcgcgccgggtaccggccccgcgtcgggattctcagcgctgcgccggcacaacccccggcgcatcggcgctatcagcgcctattcagacggacaataccggcctcgcctcctcttgattcgcctgtgtctttactaaatcgctttttgagaaattcctccaacatttgcataatgtgttcccgctttccgcgaccccccccccccgctcgcgcgcgcgctcccacactcacaagcacacactcacaggcgcaccctcgtacccctccttcctgcaaccgcccgccaccctgctcggcccggctgggtcccggaccctgcccgaccccggcccgggccgctcacccagtcgttcgccggctcacctggtcggtggcggggccgccctcggccggcagccggcagccctcgggcaacgccggggcggcgttctcatgcttcc

SEQ ID NO: 131013 - DNA, 67 bp, Homo sapiens; identical to SEQ ID NO: 100256
  chr9:125551770-125551837
  Hypo

SEQ ID NO: 131014 - DNA, 39 bp, Homo sapiens; identical to SEQ ID NO: 42200
  chr9:125623471-125623510
  Hypo

SEQ ID NO: 131015 - DNA, 29 bp, Homo sapiens
  chr9:125676678-125676707
  Hypo
gctgggattacaggcgtgagccaccgagc

SEQ ID NO: 131016 - DNA, 30 bp, Homo sapiens; identical to SEQ ID NO: 100259
  chr9:126090073-126090103
  Hypo

SEQ ID NO: 131017 - DNA, 30 bp, Homo sapiens; identical to SEQ ID NO: 100260
  chr9:126090387-126090417
  Hypo

SEQ ID NO: 131018 - DNA, 67 bp, Homo sapiens; identical to SEQ ID NO: 100261
  chr9:126110108-126110175
  Hypo

SEQ ID NO: 131019 - DNA, 30 bp, Homo sapiens; identical to SEQ ID NO: 100262
  chr9:126111852-126111882
  Hypo

SEQ ID NO: 131020 - DNA, 54 bp, Homo sapiens; identical to SEQ ID NO: 100263
  chr9:126125543-126125597
  Hypo

SEQ ID NO: 131021 - DNA, 331 bp, Homo sapiens; identical to SEQ ID NO: 100264
  chr9:126132902-126133233
  Hypo

SEQ ID NO: 131022 - DNA, 303 bp, Homo sapiens; identical to SEQ ID NO: 100265
  chr9:126133637-126133940
  Hypo

SEQ ID NO: 131023 - DNA, 50 bp, Homo sapiens
  chr9:126136156-126136206
  Hyper
tcgagtgccgctgcccgcctggcttcgggggcccgcgctgcaggtgggat

SEQ ID NO: 131024 - DNA, 305 bp, Homo sapiens; identical to SEQ ID NO: 100266
  chr9:126138009-126138314
  Hyper

SEQ ID NO: 131025 - DNA, 36 bp, Homo sapiens; identical to SEQ ID NO: 100267
  chr9:126139212-126139248
  Hypo

SEQ ID NO: 131026 - DNA, 176 bp, Homo sapiens; identical to SEQ ID NO: 100268
  chr9:126140319-126140495
  Hypo

SEQ ID NO: 131027 - DNA, 36 bp, Homo sapiens; identical to SEQ ID NO: 42206
  chr9:126141357-126141393
  Hypo

SEQ ID NO: 131028 - DNA, 69 bp, Homo sapiens; identical to SEQ ID NO: 100270
  chr9:126145324-126145393
  Hypo

SEQ ID NO: 131029 - DNA, 148 bp, Homo sapiens; identical to SEQ ID NO: 100271
  chr9:126152955-126153103
  Hypo

SEQ ID NO: 131030 - DNA, 340 bp, Homo sapiens; identical to SEQ ID NO: 100272
  chr9:126154211-126154551
  Hypo

SEQ ID NO: 131031 - DNA, 105 bp, Homo sapiens; identical to SEQ ID NO: 100273
  chr9:126158010-126158115
  Hypo

SEQ ID NO: 131032 - DNA, 119 bp, Homo sapiens; identical to SEQ ID NO: 100274
  chr9:126169372-126169491
  Hypo

SEQ ID NO: 131033 - DNA, 30 bp, Homo sapiens; identical to SEQ ID NO: 100275
  chr9:126283294-126283324
  Hypo

SEQ ID NO: 131034 - DNA, 30 bp, Homo sapiens; identical to SEQ ID NO: 100276
  chr9:126314151-126314181
  Hypo

SEQ ID NO: 131035 - DNA, 30 bp, Homo sapiens; identical to SEQ ID NO: 100277
  chr9:126349144-126349174
  Hypo

SEQ ID NO: 131036 - DNA, 30 bp, Homo sapiens; identical to SEQ ID NO: 100278
  chr9:126357733-126357763
  Hypo

SEQ ID NO: 131037 - DNA, 52 bp, Homo sapiens; identical to SEQ ID NO: 100279
  chr9:126405898-126405950
  Hypo

SEQ ID NO: 131038 - DNA, 141 bp, Homo sapiens; identical to SEQ ID NO: 100280
  chr9:126569628-126569769
  Hypo

SEQ ID NO: 131039 - DNA, 30 bp, Homo sapiens; identical to SEQ ID NO: 100281
  chr9:126729042-126729072
  Hypo

SEQ ID NO: 131040 - DNA, 30 bp, Homo sapiens; identical to SEQ ID NO: 100282
  chr9:126759039-126759069
  Hyper

SEQ ID NO: 131041 - DNA, 206 bp, Homo sapiens; identical to SEQ ID NO: 100283
  chr9:126760259-126760465
  Hyper

SEQ ID NO: 131042 - DNA, 165 bp, Homo sapiens; identical to SEQ ID NO: 100284
  chr9:126761476-126761641
  Hyper

SEQ ID NO: 131043 - DNA, 76 bp, Homo sapiens; identical to SEQ ID NO: 100285
  chr9:126762530-126762606
  Hyper

SEQ ID NO: 131044 - DNA, 1618 bp, Homo sapiens; identical to SEQ ID NO: 100286
  chr9:126770190-126771808
  Hyper

SEQ ID NO: 131045 - DNA, 747 bp, Homo sapiens
  chr9:126773231-126773978
  Hyper
aggctggggagagaccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcccggagcacgcgctgccagggcctggggcgccgagcggccaatggcacggcggcaggacgtgatgtcaggcgcggctgtagaaaaggcgcggaggcttgcgctggcgcggactgcagagccggggctgggctaggcgcgcgcttggagagcattgcgcgcggctgggcccgcggccggcggctcctcctcccactctgc

SEQ ID NO: 131046 - DNA, 1106 bp, Homo sapiens
  chr9:126774038-126775144
  Hyper
tcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacggtaggcgcgcggctgtggggtcggggctgagagctgggatggggccgggccagtcagcgcctctgctccccgaagtttggggagcgtccttcgtgccgcacgggactgggtgctggggatcctcggtcagaatgcaaggccggtggctcccggttcgggggaaacccggctgctgggacgcagaagggaaacaaggttgaaaccgaaatctcggccctgggggtagaggagagcgtttcttccgaactggaagcgaagtcccatccgcggcccggggcggctcccttctcaccttgcccggtgccggggtcgacagccccgcgctctcctccacctctcggctccggttgctggcggcgccgcgagcggcgccagggaagggcgaaccagctgggag

SEQ ID NO: 131047 - DNA, 116 bp, Homo sapiens; identical to SEQ ID NO: 100291
  chr9:126775412-126775528
  Hyper

SEQ ID NO: 131048 - DNA, 292 bp, Homo sapiens
  chr9:126776044-126776336
  Hyper
gcctgggttctgaaccgcccagaaatggaaatgggccttttggggtggggggaagcgcgccgcatgtcctggcagccccctccgcgttcagggtagccaaggccacagagggagttgtgggtgccggtttcccggcggcggaggggccgctggctgacgcaggcgctgctgtcttccgcctccctcccttcgcagaccatgccgtccatcagcagtgaccgcgccgcgctgtgcgccggctgcgggggcaagatctcggaccgctactacctgctggcggtggacaagcagt

SEQ ID NO: 131049 - DNA, 402 bp, Homo sapiens
  chr9:126777586-126777988
  Hyper
ggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctggtgagtgcgcggcgcacgaagcgcccccatagggttgggggaaagtgtgcggcctcgacggccgggagctggattgaatctctgtgtgctgggcaaatagcgagccttaagcaccggacggcctcgcagaagggacattagccccctgggcttccagactgtgcgtcctcggctggagcgggag

SEQ ID NO: 131050 - DNA, 137 bp, Homo sapiens; identical to SEQ ID NO: 100296
  chr9:126778381-126778518
  Hyper

SEQ ID NO: 131051 - DNA, 103 bp, Homo sapiens
  chr9:126779147-126779250
  Hyper
aaaccgagttcagaccggctcccccaacaccaagccgcttctatttatcaagtgggtcaacttccactcggaagcacctcgcggggctcggctccagggcacc

SEQ ID NO: 131052 - DNA, 839 bp, Homo sapiens
  chr9:126779476-126780315
  Hyper
tctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccgggcgctgggcttacagcagagccgcgggccgcggggtcggaaagtccttccggggcggggccgcagcggcctcttcccgcagcccctcgggcccgggccccggtggaacggaaacctccccctaccccgggaggggctgccagcgggctgggggtgcgaaaacggcggcaggagcgggcgaggggcccgggccgcgcactttgcgcctgggtttgcgcgccgcggccgcgggagtcccgcgcggaccggccggacgcccggcctcccccagcc

SEQ ID NO: 131053 - DNA, 390 bp, Homo sapiens; identical to SEQ ID NO: 100300
  chr9:126780564-126780954
  Hyper

SEQ ID NO: 131054 - DNA, 213 bp, Homo sapiens; identical to SEQ ID NO: 100301
  chr9:126781161-126781374
  Hyper

SEQ ID NO: 131055 - DNA, 30 bp, Homo sapiens; identical to SEQ ID NO: 32689
  chr9:126782415-126782445
  Hyper

SEQ ID NO: 131056 - DNA, 140 bp, Homo sapiens; identical to SEQ ID NO: 100303
  chr9:126783400-126783540
  Hyper

SEQ ID NO: 131057 - DNA, 294 bp, Homo sapiens; identical to SEQ ID NO: 32691
  chr9:126785057-126785351
  Hyper

SEQ ID NO: 131058 - DNA, 30 bp, Homo sapiens; identical to SEQ ID NO: 100305
  chr9:126794671-126794701
  Hyper

SEQ ID NO: 131059 - DNA, 66 bp, Homo sapiens; identical to SEQ ID NO: 100306
  chr9:126807864-126807930
  Hyper

SEQ ID NO: 131060 - DNA, 75 bp, Homo sapiens; identical to SEQ ID NO: 100307
  chr9:126872665-126872740
  Hyper

SEQ ID NO: 131061 - DNA, 170 bp, Homo sapiens; identical to SEQ ID NO: 100308
  chr9:126930838-126931008
  Hypo

SEQ ID NO: 131062 - DNA, 54 bp, Homo sapiens; identical to SEQ ID NO: 100309
  chr9:127106240-127106294
  Hypo

SEQ ID NO: 131063 - DNA, 410 bp, Homo sapiens; identical to SEQ ID NO: 100310
  chr9:127212654-127213064
  Hyper

SEQ ID NO: 131064 - DNA, 171 bp, Homo sapiens; identical to SEQ ID NO: 100311
  chr9:127215802-127215973
  Hyper

SEQ ID NO: 131065 - DNA, 196 bp, Homo sapiens; identical to SEQ ID NO: 100312
  chr9:127239774-127239970
  Hyper

SEQ ID NO: 131066 - DNA, 681 bp, Homo sapiens
  chr9:127265595-127266276
  Hyper
gtccgtagtggtagccggacaccttgtccccgcacacggggcacagctcgtccaggtcctcgtcgtacgaatagtccatgcccgcggcgtccgcctgcggagggacagcgggtcagggagggccggcggagaccggcagcctggggtccccgcggccgccgccccagccgctgtcgccggcccgtcgcgtaatcccctctctgtgcccaggcgctgccgccggcacccaccgagcgccccgcgcagcgtcccggggtgggtccggtgcagtccccgcgcccggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtgttctgggaacccgacagagacgaaggaggcagagacagagtccgggggagccagagatgggaagaaactctggcgagagacaacgaccgacgccaccgggcgcagacacgaggccagtccgagagtgccagagacacagacactgagacgcccagctagagagaacccggcggggacgagacaca

SEQ ID NO: 131067 - DNA, 1160 bp, Homo sapiens
  chr9:127266336-127267496
  Hyper
agagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgccgggcaggagcccaagcgccaaggcgaggccccgcagggtcggacccagacgggggcccgggccgcaggaggcggaaaacgacggcgccgggaccgagagcccgaaaacgcagagccgccgggaccccctccccgggggagacaaagccgcagcagcgacggcaacgggaggcgcagcccgagccgccgctgccaccgggacgtcgggcggggagacctcgggcgggggtcggcgggctccgggaagccgagcccgaggcgagggagcgacctcgggcggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcgggggcgcggggctggcggcgcgggggcctcggctcccccctcccgcctccccgccccccatcctgcctccctgttcccccccgcaccgccgccggggccgctccgaggcgcacctgggacccgggcccctcagccgccaccccgccctgcgccaacccgccgcgccggggccgggggccggcccctctatatcggcgcgtgcggtatccgggggcggaggcccggtcgtgtcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggta

SEQ ID NO: 131068 - DNA, 127 bp, Homo sapiens; identical to SEQ ID NO: 100318
  chr9:127421402-127421529
  Hyper

SEQ ID NO: 131069 - DNA, 142 bp, Homo sapiens; identical to SEQ ID NO: 100319
  chr9:127539774-127539916
  Hyper

SEQ ID NO: 131070 - DNA, 133 bp, Homo sapiens; identical to SEQ ID NO: 100320
  chr9:127597207-127597340
  Hypo

SEQ ID NO: 131071 - DNA, 82 bp, Homo sapiens; identical to SEQ ID NO: 100323
  chr9:127950686-127950768
  Hypo

SEQ ID NO: 131072 - DNA, 30 bp, Homo sapiens; identical to SEQ ID NO: 100324
  chr9:128104149-128104179
  Hypo

SEQ ID NO: 131073 - DNA, 40 bp, Homo sapiens; identical to SEQ ID NO: 100325
  chr9:128118055-128118095
  Hypo

SEQ ID NO: 131074 - DNA, 46 bp, Homo sapiens; identical to SEQ ID NO: 100326
  chr9:128190094-128190140
  Hypo

SEQ ID NO: 131075 - DNA, 30 bp, Homo sapiens; identical to SEQ ID NO: 100327
  chr9:128191341-128191371
  Hypo

SEQ ID NO: 131076 - DNA, 513 bp, Homo sapiens; identical to SEQ ID NO: 100328
  chr9:128651901-128652414
  Hyper

SEQ ID NO: 131077 - DNA, 30 bp, Homo sapiens; identical to SEQ ID NO: 42214
  chr9:128750886-128750916
  Hypo

SEQ ID NO: 131078 - DNA, 122 bp, Homo sapiens; identical to SEQ ID NO: 42215
  chr9:128759852-128759974
  Hypo

SEQ ID NO: 131079 - DNA, 111 bp, Homo sapiens; identical to SEQ ID NO: 100331
  chr9:128777807-128777918
  Hypo

SEQ ID NO: 131080 - DNA, 176 bp, Homo sapiens; identical to SEQ ID NO: 100332
  chr9:128824558-128824734
  Hypo

SEQ ID NO: 131081 - DNA, 30 bp, Homo sapiens; identical to SEQ ID NO: 100333
  chr9:128874699-128874729
  Hypo

SEQ ID NO: 131082 - DNA, 229 bp, Homo sapiens; identical to SEQ ID NO: 100334
  chr9:128984848-128985077
  Hyper

SEQ ID NO: 131083 - DNA, 30 bp, Homo sapiens; identical to SEQ ID NO: 100335
  chr9:129269531-129269561
  Hypo

SEQ ID NO: 131084 - DNA, 364 bp, Homo sapiens
  chr9:129276607-129276971
  Hyper
cgggaccccgccctgcgctccgcccccaaacacgggttctcacgcggtccggccgcgcgggggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtggctcccatagactgcggggccgggcccagccgcgctcgctttggtcgggaatgcgggtcgactggaga

SEQ ID NO: 131085 - DNA, 579 bp, Homo sapiens
  chr9:129372722-129373301
  Hyper
ggcagctcatagagccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccccaggtagagagaatccgaggctgtttctgccgctgaaatctgagcgggagagcatcccgaagccgcctgcgtggagcgagcagcccccgcgtcatgggccagaggcgcccgggagaatctgcgggtcacggatcacacccgcaggggcctggcggagcaaggtgccgttcgccgcctgcgggcaggagccggctctgggcctcggcccctgctgtgccgtccagtcggccgcttcttcgcttcttcggcaagggaagcggtggagaggcgcgggagccccgattgtgctggagagatctgggacccctgcgcgtctgcgtgcgaaggacccgagaccggccaactcagctgggagcacgggacacgaggagt

SEQ ID NO: 131086 - DNA, 30 bp, Homo sapiens; identical to SEQ ID NO: 100340
  chr9:129373610-129373640
  Hyper

SEQ ID NO: 131087 - DNA, 30 bp, Homo sapiens; identical to SEQ ID NO: 100341
  chr9:129374281-129374311
  Hyper

SEQ ID NO: 131088 - DNA, 165 bp, Homo sapiens; identical to SEQ ID NO: 100342
  chr9:129374814-129374979
  Hyper

SEQ ID NO: 131089 - DNA, 88 bp, Homo sapiens; identical to SEQ ID NO: 100343
  chr9:129375295-129375383
  Hyper

SEQ ID NO: 131090 - DNA, 1073 bp, Homo sapiens; identical to SEQ ID NO: 100344
  chr9:129375725-129376798
  Hyper

SEQ ID NO: 131091 - DNA, 1147 bp, Homo sapiens
  chr9:129377017-129378164
  Hyper
agagggccgcaagtacgcctccggcaggcgtcctgaggggacaggacagctccagtcgccacccaccatcctttccaggcttaggttctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagccggccaccctgcgccgtgctcgttgtcatttgtcttaacacggagcgcggattctccggagaaggggagagcacagcgccgagccaaggctcgaggcccgcggcctctccacgccggagcccgaggactgggacggactagccggggccgcccggcccctggcgcggcggtccggggagcgcaggcggcaggcggtgatcccgggcggcccgagccctcggggccgagggctgtgggcccggtgcgaccgggacgccggggctgggccgggcggcgctgacggccgggctttcgccctgtgcgctacaggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggccgggcagctccaagggttccgagagctgcgcgtcttggggctggggcggaccagcccagcccagcgggcactgatggggtcctgggagcctccggacggcccccagttgccatccgttgtcccggaatcctgcgctgggccggccgagggatttggtgcctgggtcctgggatatagggtctggcgctacggaggcctgaattg

SEQ ID NO: 131092 - DNA, 30 bp, Homo sapiens; identical to SEQ ID NO: 32714
  chr9:129380664-129380694
  Hyper

SEQ ID NO: 131093 - DNA, 107 bp, Homo sapiens
  chr9:129381111-129381218
  Hyper
aaaatggagtctaatcgcttgtaagacagctcccaggtttggcgacccgagacccgctggggtgcaagcgggcgcctttgtgcacggcgagacgcggggttccggcc

SEQ ID NO: 131094 - DNA, 30 bp, Homo sapiens; identical to SEQ ID NO: 100350
  chr9:129381473-129381503
  Hyper

SEQ ID NO: 131095 - DNA, 30 bp, Homo sapiens; identical to SEQ ID NO: 100351
  chr9:129384076-129384106
  Hyper

SEQ ID NO: 131096 - DNA, 910 bp, Homo sapiens
  chr9:129385872-129386782
  Hyper
tccaactcccaaagccggatgggttctctaagtcctcctataccgaccttccggaaggtgcgggctctacattgttgctaatctcccccagaacgcccagcctgggaggggtggggagggggagtcgctacccgagggctgggagcagggtgtcactgacctcctctgcgcggattgccccctgtagggccagccctggccagcggaagaaaaaggttagaataattgccttcccctgggcgggagagcttccttcgacgtccggacacgcggatggggcggctttcagcggcctccacccgcgcacccctccaggcccacctctcggcggttcgtgcagcatgttctttactgggagtgggatgacaccatgcataggctcctgggctccgcagccgagccgcgggcaccagcggcggttgatgaatttcggtgtcaccaggggtttagcccggatttgggaaccgcgcgctctaatacgcgcacacggtcctgccctttctaaagcgcagccctttcacccagcagctgatttatggaggaattcgatcctgggacgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaa

SEQ ID NO: 131097 - DNA, 1729 bp, Homo sapiens
  chr9:129387515-129389244
  Hyper
ttgggcctcaggagccggagcgttgccgtgggggcgggggaaggggtggttttgcgggtgccttaattggcagcgtctggaaaatggggacagtgaccccacgactagaggatgaatggggggagggttagtgggatgtgtttgcctcctctgaccgagagcacgggtcctgctctgtcccctcttcccaggaaaggtggcactccgggtgcacacccaccacccccattaaagcgggattgaccagaagagagaggccgaatggagatgccaggctggggccctcggcggggcagatttcgttggatccctgggactaatgtcgcagcgctcgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctcatggacatgggggtggggagctcgtggggtttcagcccaaaggctccagtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtgtcacctcgtaaaagcgacaggcaaggactgttttatggggagggagaaggagcaggaagtgatgcttccatctctgacagcatagggaccgggagctccgatggaggaaaccctttccgggcaggacgagtagagggacaggacatggccggggaccatgggattcgctgccattaagtatgggacgggcaggcgagagcggggaaggggaccgatggagccagaagccctgagctcacctcccgcccgtcctctcctggagccccctctgcaatcccggctcagtcggcaaccggcccttccttccaggtcaggggtgggggagagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccgggctcctctgcag

SEQ ID NO: 131098 - DNA, 411 bp, Homo sapiens; identical to SEQ ID NO: 100357
  chr9:129400848-129401259
  Hyper

SEQ ID NO: 131099 - DNA, 109 bp, Homo sapiens; identical to SEQ ID NO: 100358
  chr9:129414414-129414523
  Hyper

SEQ ID NO: 131100 - DNA, 215 bp, Homo sapiens; identical to SEQ ID NO: 100359
  chr9:129438508-129438723
  Hyper

SEQ ID NO: 131101 - DNA, 678 bp, Homo sapiens; identical to SEQ ID NO: 100360
  chr9:129445222-129445900
  Hyper

SEQ ID NO: 131102 - DNA, 346 bp, Homo sapiens
  chr9:129485680-129486026
  Hyper
agagccgcctgacaccgtgatatccgcctggctcgctgcgctccgggtgatggatggggcggagctccccaccccccagccccggaacctggcgcccctcccagaaacaccgctccgctgccacacacgcggccgccggactcccagccaccggcgcactcacgcggcgccccccacgcatcagcccggcgcgcacgaagggaaccgttcctcttcccagtcccctggcgctagcaccagcaggactgcccttagcgcacaccacaccttacccacttgcccatcacacagcctcttccgcgcacgcacatacacatgcatgcaagctgcacgccacccctcccgc

SEQ ID NO: 131103 - DNA, 38 bp, Homo sapiens; identical to SEQ ID NO: 100363
  chr9:129627928-129627966
  Hypo

SEQ ID NO: 131104 - DNA, 412 bp, Homo sapiens; identical to SEQ ID NO: 100364
  chr9:130179969-130180381
  Hypo

SEQ ID NO: 131105 - DNA, 103 bp, Homo sapiens; identical to SEQ ID NO: 100365
  chr9:130248346-130248449
  Hypo

SEQ ID NO: 131106 - DNA, 30 bp, Homo sapiens; identical to SEQ ID NO: 100366
  chr9:130256609-130256639
  Hypo

SEQ ID NO: 131107 - DNA, 20 bp, Homo sapiens
  chr9:130262351-130262371
  Hypo
cttagcagccgggcacgttg

SEQ ID NO: 131108 - DNA, 35 bp, Homo sapiens; identical to SEQ ID NO: 100368
  chr9:130326063-130326098
  Hypo

SEQ ID NO: 131109 - DNA, 50 bp, Homo sapiens; identical to SEQ ID NO: 100369
  chr9:130362069-130362119
  Hypo

SEQ ID NO: 131110 - DNA, 328 bp, Homo sapiens
  chr9:130461603-130461931
  Hyper
accgacactcgaggccgaaacactgtgagcaaggaaaaggccgacacccaacaccggtcacgcggcggatcagacgcggcctcgggactgggcttggggaggccgggcttccggggctagtaagcgtctactagccgggctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 131111 - DNA, 27 bp, Homo sapiens
  chr9:130505479-130505506
  Hypo
ttaaatattcagttacggtcggccggg

SEQ ID NO: 131112 - DNA, 30 bp, Homo sapiens; identical to SEQ ID NO: 42222
  chr9:130534900-130534930
  Hypo

SEQ ID NO: 131113 - DNA, 30 bp, Homo sapiens; identical to SEQ ID NO: 100373
  chr9:130587535-130587565
  Hypo

SEQ ID NO: 131114 - DNA, 34 bp, Homo sapiens; identical to SEQ ID NO: 100374
  chr9:130639978-130640012
  Hyper

SEQ ID NO: 131115 - DNA, 93 bp, Homo sapiens; identical to SEQ ID NO: 100375
  chr9:130676150-130676243
  Hypo

SEQ ID NO: 131116 - DNA, 224 bp, Homo sapiens
  chr9:130689420-130689644
  Hyper
aggccactcacctctcggagatgcggccggcggggtagaagacgctctgcatgacgatgaagtacgtctgggggccgggacagggagtgagggaggccggctgtcgccctccagccgcccgctccgcccagccacctcgcctcggcttcacccaccttctttccccggtccacccgcagactgtgcactcctggaaggggagagggcgccggatgaggatcccc

SEQ ID NO: 131117 - DNA, 125 bp, Homo sapiens; identical to SEQ ID NO: 100378
  chr9:130828878-130829003
  Hypo

SEQ ID NO: 131118 - DNA, 30 bp, Homo sapiens; identical to SEQ ID NO: 42224
  chr9:130857460-130857490
  Hypo

SEQ ID NO: 131119 - DNA, 30 bp, Homo sapiens; identical to SEQ ID NO: 100380
  chr9:130870626-130870656
  Hypo

SEQ ID NO: 131120 - DNA, 30 bp, Homo sapiens; identical to SEQ ID NO: 100381
  chr9:130908223-130908253
  Hypo

SEQ ID NO: 131121 - DNA, 30 bp, Homo sapiens; identical to SEQ ID NO: 100382
  chr9:130980679-130980709
  Hypo

SEQ ID NO: 131122 - DNA, 21 bp, Homo sapiens
  chr9:131060946-131060967
  Hypo
ccaccgcgcctggccccttgg

SEQ ID NO: 131123 - DNA, 30 bp, Homo sapiens; identical to SEQ ID NO: 100384
  chr9:131083970-131084000
  Hypo

SEQ ID NO: 131124 - DNA, 109 bp, Homo sapiens; identical to SEQ ID NO: 100385
  chr9:131095776-131095885
  Hypo

SEQ ID NO: 131125 - DNA, 115 bp, Homo sapiens; identical to SEQ ID NO: 32725
  chr9:131127226-131127341
  Hyper

SEQ ID NO: 131126 - DNA, 210 bp, Homo sapiens; identical to SEQ ID NO: 100387
  chr9:131159439-131159649
  Hyper

SEQ ID NO: 131127 - DNA, 167 bp, Homo sapiens; identical to SEQ ID NO: 100388
  chr9:131217228-131217395
  Hypo

SEQ ID NO: 131128 - DNA, 42 bp, Homo sapiens; identical to SEQ ID NO: 100389
  chr9:131399249-131399291
  Hypo

SEQ ID NO: 131129 - DNA, 24 bp, Homo sapiens
  chr9:131417485-131417509
  Hypo
aaagttagcctgggccggcgcggt

SEQ ID NO: 131130 - DNA, 278 bp, Homo sapiens; identical to SEQ ID NO: 42228
  chr9:131504870-131505148
  Hypo

SEQ ID NO: 131131 - DNA, 105 bp, Homo sapiens; identical to SEQ ID NO: 42229
  chr9:131579999-131580104
  Hypo

SEQ ID NO: 131132 - DNA, 30 bp, Homo sapiens; identical to SEQ ID NO: 100393
  chr9:131607517-131607547
  Hypo

SEQ ID NO: 131133 - DNA, 30 bp, Homo sapiens; identical to SEQ ID NO: 100394
  chr9:131607770-131607800
  Hypo

SEQ ID NO: 131134 - DNA, 30 bp, Homo sapiens; identical to SEQ ID NO: 100395
  chr9:131652716-131652746
  Hypo

SEQ ID NO: 131135 - DNA, 24 bp, Homo sapiens
  chr9:131693810-131693834
  Hypo
cttttttttttgagacggagtctc

SEQ ID NO: 131136 - DNA, 17 bp, Homo sapiens
  chr9:131814818-131814835
  Hypo
gccgaggcaggaggacc

SEQ ID NO: 131137 - DNA, 35 bp, Homo sapiens; identical to SEQ ID NO: 100398
  chr9:131821609-131821644
  Hypo

SEQ ID NO: 131138 - DNA, 162 bp, Homo sapiens; identical to SEQ ID NO: 100399
  chr9:131822028-131822190
  Hypo

SEQ ID NO: 131139 - DNA, 69 bp, Homo sapiens; identical to SEQ ID NO: 100400
  chr9:131842877-131842946
  Hyper

SEQ ID NO: 131140 - DNA, 420 bp, Homo sapiens; identical to SEQ ID NO: 100401
  chr9:131854046-131854466
  Hypo

SEQ ID NO: 131141 - DNA, 91 bp, Homo sapiens; identical to SEQ ID NO: 100402
  chr9:131868867-131868958
  Hypo

SEQ ID NO: 131142 - DNA, 118 bp, Homo sapiens; identical to SEQ ID NO: 100403
  chr9:131870288-131870406
  Hypo

SEQ ID NO: 131143 - DNA, 462 bp, Homo sapiens
  chr9:131872458-131872920
  Hyper
gtctctctcccctaccggcctgtctctgggtctaagggtgggggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtccgcgccgccgccgccgcggctggggtcggtgggtccttgctagagccttcgggccaaggtcgctgagttacagcc

SEQ ID NO: 131144 - DNA, 26 bp, Homo sapiens
  chr9:132000549-132000575
  Hypo
atcctctcccatgtgcgccttctctt

SEQ ID NO: 131145 - DNA, 193 bp, Homo sapiens; identical to SEQ ID NO: 100407
  chr9:132020917-132021110
  Hyper

SEQ ID NO: 131146 - DNA, 144 bp, Homo sapiens; identical to SEQ ID NO: 42233
  chr9:132040507-132040651
  Hypo

SEQ ID NO: 131147 - DNA, 35 bp, Homo sapiens; identical to SEQ ID NO: 100409
  chr9:132114141-132114176
  Hyper

SEQ ID NO: 131148 - DNA, 30 bp, Homo sapiens; identical to SEQ ID NO: 100410
  chr9:132114392-132114422
  Hyper

SEQ ID NO: 131149 - DNA, 75 bp, Homo sapiens; identical to SEQ ID NO: 100411
  chr9:132197706-132197781
  Hypo

SEQ ID NO: 131150 - DNA, 30 bp, Homo sapiens; identical to SEQ ID NO: 100412
  chr9:132200261-132200291
  Hyper

SEQ ID NO: 131151 - DNA, 42 bp, Homo sapiens; identical to SEQ ID NO: 100413
  chr9:132244699-132244741
  Hyper

SEQ ID NO: 131152 - DNA, 50 bp, Homo sapiens; identical to SEQ ID NO: 100414
  chr9:132245295-132245345
  Hyper

SEQ ID NO: 131153 - DNA, 18 bp, Homo sapiens
  chr9:132257308-132257326
  Hypo
acccggcaacagaacata

SEQ ID NO: 131154 - DNA, 23 bp, Homo sapiens
  chr9:132268469-132268492
  Hypo
ttggcctgcgataaaattgcaca

SEQ ID NO: 131155 - DNA, 105 bp, Homo sapiens; identical to SEQ ID NO: 100417
  chr9:132331231-132331336
  Hyper

SEQ ID NO: 131156 - DNA, 456 bp, Homo sapiens; identical to SEQ ID NO: 100418
  chr9:132359682-132360138
  Hyper

SEQ ID NO: 131157 - DNA, 822 bp, Homo sapiens
  chr9:132382195-132383017
  Hyper
ctcaaggacgggttgcgagggctctgagatactcagctaacattagcatccttctagcctgggtggtggggtggtgggtgcggggacacaagggaccaccccccaccggaaatgactcgggcccgccccccgggccccgcggggcctcactcagtggctccggctcctcggcgcacttctcctggagctggtgcaggaactcacggaacctgctggggaggagctctcctaggaaggcgcccaagaagtcggggtcctccctggccacgcgcctccgggggcgctcgcgctctccaggccctggctgcctgggcgccgattcccgggacgcgccggccgacagcaggggaggcggcagcagggaccgcagcagcccccgcttccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcgagtggcttcaggc

SEQ ID NO: 131158 - DNA, 235 bp, Homo sapiens; identical to SEQ ID NO: 100421
  chr9:132402075-132402310
  Hypo

SEQ ID NO: 131159 - DNA, 485 bp, Homo sapiens; identical to SEQ ID NO: 100422
  chr9:132402755-132403240
  Hypo

SEQ ID NO: 131160 - DNA, 71 bp, Homo sapiens
  chr9:132427621-132427692
  Hyper
tgggagtggggggctcgtcgccttcgtctctgggccgccccctccacctgcggaggcgattgtaaagggaa

SEQ ID NO: 131161 - DNA, 71 bp, Homo sapiens; identical to SEQ ID NO: 32732
  chr9:132428052-132428123
  Hyper

SEQ ID NO: 131162 - DNA, 277 bp, Homo sapiens; identical to SEQ ID NO: 100426
  chr9:132428401-132428678
  Hyper

SEQ ID NO: 131163 - DNA, 392 bp, Homo sapiens; identical to SEQ ID NO: 100427
  chr9:132459541-132459933
  Hyper

SEQ ID NO: 131164 - DNA, 93 bp, Homo sapiens; identical to SEQ ID NO: 42235
  chr9:132491528-132491621
  Hypo

SEQ ID NO: 131165 - DNA, 37 bp, Homo sapiens; identical to SEQ ID NO: 100429
  chr9:132513020-132513057
  Hypo

SEQ ID NO: 131166 - DNA, 30 bp, Homo sapiens; identical to SEQ ID NO: 100430
  chr9:132523662-132523692
  Hypo

SEQ ID NO: 131167 - DNA, 120 bp, Homo sapiens; identical to SEQ ID NO: 100431
  chr9:132559293-132559413
  Hypo

SEQ ID NO: 131168 - DNA, 30 bp, Homo sapiens; identical to SEQ ID NO: 100432
  chr9:132643791-132643821
  Hypo

SEQ ID NO: 131169 - DNA, 161 bp, Homo sapiens; identical to SEQ ID NO: 100433
  chr9:132691954-132692115
  Hypo

SEQ ID NO: 131170 - DNA, 30 bp, Homo sapiens; identical to SEQ ID NO: 100438
  chr9:132805344-132805374
  Hyper

SEQ ID NO: 131171 - DNA, 48 bp, Homo sapiens; identical to SEQ ID NO: 100439
  chr9:132805845-132805893
  Hyper

SEQ ID NO: 131172 - DNA, 120 bp, Homo sapiens; identical to SEQ ID NO: 100440
  chr9:132815000-132815120
  Hypo

SEQ ID NO: 131173 - DNA, 100 bp, Homo sapiens; identical to SEQ ID NO: 100441
  chr9:132881395-132881495
  Hypo

SEQ ID NO: 131174 - DNA, 30 bp, Homo sapiens; identical to SEQ ID NO: 100442
  chr9:133267430-133267460
  Hypo

SEQ ID NO: 131175 - DNA, 30 bp, Homo sapiens; identical to SEQ ID NO: 100443
  chr9:133270785-133270815
  Hypo

SEQ ID NO: 131176 - DNA, 216 bp, Homo sapiens; identical to SEQ ID NO: 100444
  chr9:133308836-133309052
  Hyper

SEQ ID NO: 131177 - DNA, 36 bp, Homo sapiens; identical to SEQ ID NO: 100445
  chr9:133319966-133320002
  Hyper

SEQ ID NO: 131178 - DNA, 367 bp, Homo sapiens; identical to SEQ ID NO: 100446
  chr9:133320407-133320774
  Hyper

SEQ ID NO: 131179 - DNA, 30 bp, Homo sapiens; identical to SEQ ID NO: 100447
  chr9:133366620-133366650
  Hypo

SEQ ID NO: 131180 - DNA, 23 bp, Homo sapiens
  chr9:133409075-133409098
  Hypo
ttttttttttttagacggagtct

SEQ ID NO: 131181 - DNA, 86 bp, Homo sapiens; identical to SEQ ID NO: 100449
  chr9:133506386-133506472
  Hypo

SEQ ID NO: 131182 - DNA, 30 bp, Homo sapiens; identical to SEQ ID NO: 42237
  chr9:133510031-133510061
  Hypo

SEQ ID NO: 131183 - DNA, 161 bp, Homo sapiens; identical to SEQ ID NO: 100451
  chr9:133518349-133518510
  Hypo

SEQ ID NO: 131184 - DNA, 4655 bp, Homo sapiens
  chr9:133534565-133539220
  Hyper
tgcttccttcatctccgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttgtctctcccgagccttgaaagctaattacattgggaggggacaggggtggggtgggagagggggccgctgtccccattcactgagccgaggccgccactccgccggcagccccgcgcaggcctggccccgagtcacgtctgttgaaaccgtttttttcggcctcgcccccacccgccttggcagccagccgcgcctttgtacgcgccggcgggggcgccctggaaccctgaaccgtcttacggggaacgggggtggggggaggggagcggcgcgggccccacgcgaggaaggaatttcctgggccactgcgaaagattgaggctcagaaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgcaggggaagccaggacggagcgcagcaccggcaggggagggttgccgaggggctgtgccgaggagcccgggtgggggcggctggaccgcgggccgcgggactcacagacagtgcgaggcggcgcgggggcccctctccctatgcggggctggggcgcaggggctgggcggggcgggtgggcgtctgagcgcggcgcgggcgcattcttcgccttttcttcctcgggctcattccggccgatcgatacctgcgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaagacgggctttcactcggcccccaaaaatgtatttctcggcggacaatgggcttctttctgcgcctctgagggccggcggggcgggcagggcggggacccgtgcgctttggccccgcctgaccgactcgcacccccctcccccgcacccaggcccgggccccagagcgagggcgcaggagccgcgaagccggccgcccttccgagcgtccccctgaagcgcactgtcgggacctggctctcccggagctaagccccggcgcaccggcgagaacgaaagcgtcgtgcggggccctgggctgtcccacacgcccccgttctcataggtgcctcagccgggccgaagggacgcgcgctggtgcctcaaggggaggacgaacggacctccgggcttgggccgcggcctccttcccctcggcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccactcccgtgggctcaggggaagagggcacccgggcggcgaggatgacctccgaagagccgcggcaaattgattcgttccgcccggagccggggccgcgtgaatgggggcccgggcggcggcggcagcggagaagaggataaagatgttctccctgaaagggggagggggcgcggagcgggaagcggggccattcactcctggcccggcccctcgggaagccgcgccgaagaaagggggccgaggcctattcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacagacctgagggcttcccgcagtgggacgtggccctggagagggcaaaatcctcggggttgtcgtggggtaaagtgatcttacccaaagagagaccaagcaaagaaacctcagttcacaaagtccaactcaaaccattgcacagacagggacaccgaggcccagagaggaaaggggcagtccacaggacacacagcagtccttatccccctttggtgtcctggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 131185 - DNA, 1010 bp, Homo sapiens
  chr9:133539486-133540496
  Hyper
gggtactgtttggagcggtccgcgcgcccccgcccctcgcgctctcgcgacgaaggctcctcgagcccagccgggtacaacaagtctgtcctccgacgtcagggggtcattaataaccaattaggagggtcactgcggctcctataaaggcgctgagattttgccaaggggaagacggccccggccgagtgtgcgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcggtgagtccagccgtcggagcccggcgcaatccctcctcccggcgacccccattcccgtcctggcgatgcgcgagacgcggctgggatacccggcctcgctgctactcgcgccaacctgggctctcccggcgctcggtgcacctcagtttccccatgggccaaaccaggacgcgagccaccaagcagctccgcagcccacccggctcaaggaccgaccccggcgaccccgtcgc

SEQ ID NO: 131186 - DNA, 1363 bp, Homo sapiens; identical to SEQ ID NO: 100459
  chr9:133541059-133542422
  Hyper

SEQ ID NO: 131187 - DNA, 90 bp, Homo sapiens; identical to SEQ ID NO: 100460
  chr9:133550849-133550939
  Hypo

SEQ ID NO: 131188 - DNA, 16 bp, Homo sapiens
  chr9:133585587-133585603
  Hypo
gcgactgagcgagact

SEQ ID NO: 131189 - DNA, 24 bp, Homo sapiens
  chr9:133604058-133604082
  Hypo
gagccactgcgcccagcctgtttt

SEQ ID NO: 131190 - DNA, 69 bp, Homo sapiens; identical to SEQ ID NO: 100463
  chr9:133767809-133767878
  Hypo

SEQ ID NO: 131191 - DNA, 30 bp, Homo sapiens; identical to SEQ ID NO: 100464
  chr9:133772234-133772264
  Hypo

SEQ ID NO: 131192 - DNA, 30 bp, Homo sapiens; identical to SEQ ID NO: 100465
  chr9:133772670-133772700
  Hypo

SEQ ID NO: 131193 - DNA, 367 bp, Homo sapiens; identical to SEQ ID NO: 100466
  chr9:133773692-133774059
  Hypo

SEQ ID NO: 131194 - DNA, 38 bp, Homo sapiens; identical to SEQ ID NO: 100467
  chr9:133777251-133777289
  Hypo

SEQ ID NO: 131195 - DNA, 611 bp, Homo sapiens; identical to SEQ ID NO: 100468
  chr9:133779336-133779947
  Hypo

SEQ ID NO: 131196 - DNA, 44 bp, Homo sapiens; identical to SEQ ID NO: 100469
  chr9:133782143-133782187
  Hypo

SEQ ID NO: 131197 - DNA, 72 bp, Homo sapiens; identical to SEQ ID NO: 100470
  chr9:133787196-133787268
  Hypo

SEQ ID NO: 131198 - DNA, 48 bp, Homo sapiens; identical to SEQ ID NO: 100471
  chr9:133788368-133788416
  Hypo

SEQ ID NO: 131199 - DNA, 30 bp, Homo sapiens; identical to SEQ ID NO: 100472
  chr9:133794635-133794665
  Hypo

SEQ ID NO: 131200 - DNA, 81 bp, Homo sapiens; identical to SEQ ID NO: 100473
  chr9:133799115-133799196
  Hypo

SEQ ID NO: 131201 - DNA, 30 bp, Homo sapiens; identical to SEQ ID NO: 100474
  chr9:133808587-133808617
  Hyper

SEQ ID NO: 131202 - DNA, 34 bp, Homo sapiens; identical to SEQ ID NO: 100475
  chr9:133814201-133814235
  Hyper

SEQ ID NO: 131203 - DNA, 70 bp, Homo sapiens; identical to SEQ ID NO: 100476
  chr9:133814841-133814911
  Hyper

SEQ ID NO: 131204 - DNA, 70 bp, Homo sapiens; identical to SEQ ID NO: 100477
  chr9:133815217-133815287
  Hyper

SEQ ID NO: 131205 - DNA, 30 bp, Homo sapiens; identical to SEQ ID NO: 100478
  chr9:133819170-133819200
  Hypo

SEQ ID NO: 131206 - DNA, 33 bp, Homo sapiens; identical to SEQ ID NO: 100479
  chr9:133857774-133857807
  Hypo

SEQ ID NO: 131207 - DNA, 64 bp, Homo sapiens; identical to SEQ ID NO: 42243
  chr9:133864850-133864914
  Hypo

SEQ ID NO: 131208 - DNA, 189 bp, Homo sapiens; identical to SEQ ID NO: 42244
  chr9:133865355-133865544
  Hypo

SEQ ID NO: 131209 - DNA, 577 bp, Homo sapiens; identical to SEQ ID NO: 100482
  chr9:133884368-133884945
  Hyper

SEQ ID NO: 131210 - DNA, 90 bp, Homo sapiens; identical to SEQ ID NO: 100483
  chr9:133901867-133901957
  Hypo

SEQ ID NO: 131211 - DNA, 65 bp, Homo sapiens; identical to SEQ ID NO: 100484
  chr9:133911658-133911723
  Hypo

SEQ ID NO: 131212 - DNA, 134 bp, Homo sapiens; identical to SEQ ID NO: 100485
  chr9:133927347-133927481
  Hypo

SEQ ID NO: 131213 - DNA, 66 bp, Homo sapiens; identical to SEQ ID NO: 100486
  chr9:133928206-133928272
  Hypo

SEQ ID NO: 131214 - DNA, 241 bp, Homo sapiens; identical to SEQ ID NO: 100487
  chr9:133936538-133936779
  Hypo

SEQ ID NO: 131215 - DNA, 30 bp, Homo sapiens; identical to SEQ ID NO: 100488
  chr9:133948389-133948419
  Hypo

SEQ ID NO: 131216 - DNA, 30 bp, Homo sapiens; identical to SEQ ID NO: 100489
  chr9:133971630-133971660
  Hyper

SEQ ID NO: 131217 - DNA, 190 bp, Homo sapiens; identical to SEQ ID NO: 100490
  chr9:133971948-133972138
  Hyper

SEQ ID NO: 131218 - DNA, 31 bp, Homo sapiens; identical to SEQ ID NO: 42247
  chr9:134119973-134120004
  Hypo

SEQ ID NO: 131219 - DNA, 28 bp, Homo sapiens
  chr9:134120951-134120979
  Hypo
gggagagacccaccgatcctgtggggct

SEQ ID NO: 131220 - DNA, 30 bp, Homo sapiens; identical to SEQ ID NO: 100493
  chr9:134131898-134131928
  Hyper

SEQ ID NO: 131221 - DNA, 126 bp, Homo sapiens; identical to SEQ ID NO: 42248
  chr9:134135879-134136005
  Hypo

SEQ ID NO: 131222 - DNA, 94 bp, Homo sapiens; identical to SEQ ID NO: 100495
  chr9:134136231-134136325
  Hypo

SEQ ID NO: 131223 - DNA, 753 bp, Homo sapiens; identical to SEQ ID NO: 100496
  chr9:134151929-134152682
  Hyper

SEQ ID NO: 131224 - DNA, 225 bp, Homo sapiens; identical to SEQ ID NO: 32753
  chr9:134158243-134158468
  Hyper

SEQ ID NO: 131225 - DNA, 142 bp, Homo sapiens; identical to SEQ ID NO: 100498
  chr9:134171926-134172068
  Hypo

SEQ ID NO: 131226 - DNA, 25 bp, Homo sapiens
  chr9:134176645-134176670
  Hypo
gcgctggcctcgaaaggcagatttt

SEQ ID NO: 131227 - DNA, 739 bp, Homo sapiens; identical to SEQ ID NO: 100500
  chr9:134191006-134191745
  Hypo

SEQ ID NO: 131228 - DNA, 81 bp, Homo sapiens; identical to SEQ ID NO: 100501
  chr9:134207916-134207997
  Hypo

SEQ ID NO: 131229 - DNA, 35 bp, Homo sapiens; identical to SEQ ID NO: 100502
  chr9:134421523-134421558
  Hyper

SEQ ID NO: 131230 - DNA, 61 bp, Homo sapiens; identical to SEQ ID NO: 100503
  chr9:134421906-134421967
  Hyper

SEQ ID NO: 131231 - DNA, 33 bp, Homo sapiens; identical to SEQ ID NO: 100504
  chr9:134648075-134648108
  Hypo

SEQ ID NO: 131232 - DNA, 122 bp, Homo sapiens; identical to SEQ ID NO: 100505
  chr9:134717223-134717345
  Hypo

SEQ ID NO: 131233 - DNA, 30 bp, Homo sapiens; identical to SEQ ID NO: 100506
  chr9:134717710-134717740
  Hypo

SEQ ID NO: 131234 - DNA, 30 bp, Homo sapiens; identical to SEQ ID NO: 100507
  chr9:134718796-134718826
  Hypo

SEQ ID NO: 131235 - DNA, 29 bp, Homo sapiens
  chr9:134723620-134723649
  Hypo
gtgggtggctctgacgctaagactggcct

SEQ ID NO: 131236 - DNA, 30 bp, Homo sapiens; identical to SEQ ID NO: 42254
  chr9:134724244-134724274
  Hypo

SEQ ID NO: 131237 - DNA, 416 bp, Homo sapiens; identical to SEQ ID NO: 100510
  chr9:134818649-134819065
  Hypo

SEQ ID NO: 131238 - DNA, 341 bp, Homo sapiens; identical to SEQ ID NO: 100511
  chr9:134913048-134913389
  Hypo

SEQ ID NO: 131239 - DNA, 30 bp, Homo sapiens; identical to SEQ ID NO: 100512
  chr9:134915848-134915878
  Hypo

SEQ ID NO: 131240 - DNA, 30 bp, Homo sapiens; identical to SEQ ID NO: 100513
  chr9:135012697-135012727
  Hypo

SEQ ID NO: 131241 - DNA, 30 bp, Homo sapiens; identical to SEQ ID NO: 42257
  chr9:135027845-135027875
  Hypo

SEQ ID NO: 131242 - DNA, 860 bp, Homo sapiens
  chr9:135036580-135037440
  Hyper
tccacccacccaccccggtacccactgcttggggccttctgggtggcagcacttcacagagagagaccgaggagcagccctgagcccttggctgtggggggtgggggaactgactcacttggcccccctccctcgtgccgatggggcagcccccacacccatgggcgctggcaccccggcaggcccccgggttttggaagaggaagctgcagcccggctgcgcctgaccggagccggctgaggatgcgctctgggcgcagggacccgctggcccccgggccgggaggcgatgtttaggcagcgaccccccagaggctgccggggccaccctggccacgggcccgccgggacgcccctgctcgccgcgcccctccccgggccgtggcgcgtcccccgagccgcgcaatatttccttcctgcacctttaagaagaccgttgctccgtggtgggatggtgtgttaaagccacacagaggaagttacgcagcccggatcagaccgagagataaaagccccgatggtgatcgtgagtgatggcaagaggatttagcctcggcattaacttggagcggagtgcaggggggcagtgaagcgcccgccatctggcccgcgccgcgccggggggatgccccggctccccgacgagacgccgcgaagcccacccgggccgggggctgcccggcgcccgagcgcgggtcctccccgggccgcccaggggggccaaaaagtttgcacttgttagcggcgacctcccgctcagcccgggcgggcgatgcgggcggcgcgggcggccccctcccccggcccgcgtctccgggacggctgcgggcggcccccccggcggccggagggctccctgg

SEQ ID NO: 131243 - DNA, 225 bp, Homo sapiens
  chr9:135038238-135038463
  Hyper
gcactggtttggggccggcgtggagtcgaacctggaactgagcggcgcgcaggtggggggagcagaggcggcgggaaggcgggaagagaggaccgcgggctcgcggggtccgcccgctccggagtaagttggccgtctgggctgggggcggcggcggccgggtcgccacaggcggcagcgccggggcaaaggatacagccagttcctgggcgccctgctctgtgt

SEQ ID NO: 131244 - DNA, 30 bp, Homo sapiens; identical to SEQ ID NO: 42258
  chr9:135054774-135054804
  Hypo

SEQ ID NO: 131245 - DNA, 17 bp, Homo sapiens
  chr9:135067234-135067251
  Hypo
ggcgtgagccaccgcgc

SEQ ID NO: 131246 - DNA, 114 bp, Homo sapiens; identical to SEQ ID NO: 100521
  chr9:135091410-135091524
  Hypo

SEQ ID NO: 131247 - DNA, 175 bp, Homo sapiens; identical to SEQ ID NO: 100522
  chr9:135102332-135102507
  Hypo

SEQ ID NO: 131248 - DNA, 165 bp, Homo sapiens; identical to SEQ ID NO: 100523
  chr9:135116306-135116471
  Hyper

SEQ ID NO: 131249 - DNA, 40 bp, Homo sapiens; identical to SEQ ID NO: 100524
  chr9:135118020-135118060
  Hyper

SEQ ID NO: 131250 - DNA, 30 bp, Homo sapiens; identical to SEQ ID NO: 100525
  chr9:135121068-135121098
  Hypo

SEQ ID NO: 131251 - DNA, 92 bp, Homo sapiens; identical to SEQ ID NO: 100526
  chr9:135129056-135129148
  Hypo

SEQ ID NO: 131252 - DNA, 23 bp, Homo sapiens
  chr9:135135287-135135310
  Hypo
caaaactccgtctcaaaaaaaca

SEQ ID NO: 131253 - DNA, 38 bp, Homo sapiens; identical to SEQ ID NO: 100528
  chr9:135230930-135230968
  Hypo

SEQ ID NO: 131254 - DNA, 30 bp, Homo sapiens; identical to SEQ ID NO: 100529
  chr9:135239643-135239673
  Hypo

SEQ ID NO: 131255 - DNA, 992 bp, Homo sapiens
  chr9:135285332-135286324
  Hyper
ccgtcgccaaggagacgggccgttgcattcgtcctccaggggtggtcttggttttctttcctctcccagtctgcaacgcggggcccaggagacgccctgaggatcccgcggggctcctgcattgctccggggctctttgcgatgaggggccggcgcgagcggggcgcgcctggctccggaggggtcctggcatctgagtttccccctcaggatcccggtggtgcggcccgggccgcccggcaggcccttcggagctccaggctgtgcccgacgtggggaagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggtgagcaccccacgcccaccgcgctttcgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcctcacagtgggatgataatggcaccactaaagggactgattgggaagattgaatagggtaatttctgcgggacctcgggacagcgcctgacatggggtaaggctgcaatgggtgctgctgtggtttcccacagagtgaacccacagggtgacagataggtcgcacacgcccagtctaagtcgtggctgccagccctcccagggtaaaggccgcctctccggttccgctgcacgcctggggtacgtctatgcagcggtggctccgtgtctgtcctgga

SEQ ID NO: 131256 - DNA, 68 bp, Homo sapiens; identical to SEQ ID NO: 100532
  chr9:135287745-135287813
  Hyper

SEQ ID NO: 131257 - DNA, 39 bp, Homo sapiens; identical to SEQ ID NO: 100533
  chr9:135426974-135427013
  Hypo

SEQ ID NO: 131258 - DNA, 1951 bp, Homo sapiens
  chr9:135454985-135456936
  Hyper
tggagctgggaatcccgaaatcggaataaaacgatgttattgagagagggctaaatcccagagtaaatttcaaacgaaataaatcgcacagcacattttagatgataatagacggcggtaactcaatactaatgatagtgtactgacaacccgctaatagtcttgggctccaagaagcccggcaaaaccggctggggcggcaggaggtccggctttggtgttctttcccaccgggagaggttggagccaccctcactcccggccgctctcaatcgatcgcagctcccttcgctcccaagcttcgctttcgctgggtccgggatccaaatcccaacccaagagccaaaggccagaaaaggccctggcgttgccagctgcttgtcgccctggggaggggcggctccggacccgcccggggcagaggaggacagagcggacgctctggggaccaggcggtcccgcgcatgcttggccaggggcatcgccgtggctaacaggggggttgtgtggtggcgggggctcgccgtcgatctaagtgaggatctcggtgctccgaggaagatgagattcctcaggggatgcgggcgcaggcctgggaggagtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgaccacgccaggctgcccccgggagaattctgcgtttagagggcatgcgggtgccttacgatttgctgcggtctcggtcgctgagcccgacgtaggagccggggtagtttcctgggggctgggggtggtggcaggggcgtgcaggccgggctggaaaggcctggcttcccgagcctgcggggggtaaaaggacgcctctgacccgcccgacctcgatgaaggcgtttgggctccgctctgtccgccctttccgccgcagacccgggttgcgatccctggggctgtgcagagaggatccaggcccgggacacagttcggatctgcccgcggtcctgggccccaacgccgggggctgaccctagaaaggcgctggactggagcccgtgacggggtgggaagggcgagggggcgcatgattcacaatgaaaaggccacgtttccagagttgccttgaaaatgcatccctggacgagctctggctctgcgtggaataagaagccgttagcaggcgtctacactcgcactcggaagctcttgcgtgggtcctgttcagaggtacaacagcaccggccccccaagaggtgcccatgggagaggccataagtggggggtgggcgggttactgccttctttgtcccttgagctgcctcccttgagccacacggatttctcgaggtctccctaacgcccctgacaagatcttcccaagtcctccaacctcgccctgaagtgaagccatcggtctcgtcacttcccaggaagacacctggctttccccactcccgccaggcccacagggtcccaagaggccagagagacaggactgcaaattgtcctacatgggaaacaccgagagcccaacagaaatgccgcaaacaacataacttgaattttcttccccacactagaaaaggggttctcgacgcgcgcgcgcacacacacac

SEQ ID NO: 131259 - DNA, 1651 bp, Homo sapiens
  chr9:135456996-135458647
  Hyper
tccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcacccccaaaatcggccagagccaatcagcgtcatcactccggggacacgtgggcgagtccccttaaaaaaacacacacaacacaacgaaaaaaaagaaacaacaaaaaaaaacccagacccaaagtaaaagtgacacaagttcattttttaaaggaagggggggaggagaaggcgcgcgcggaccggcagagagctgccgccgaggagcagggaggcgctgtccacggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtata

SEQ ID NO: 131260 - DNA, 746 bp, Homo sapiens; identical to SEQ ID NO: 100540
  chr9:135459996-135460742
  Hyper

SEQ ID NO: 131261 - DNA, 30 bp, Homo sapiens; identical to SEQ ID NO: 32776
  chr9:135461292-135461322
  Hyper

SEQ ID NO: 131262 - DNA, 1625 bp, Homo sapiens
  chr9:135461541-135463166
  Hyper
tcagttgaaaagtctcgatccctaacggctcaattaaccggattattgtttcctacagagagaaatcaccttgcattcagctgaaccccgtcactgcaaacgccacgcacaatgaaactccaccataaaagaaaacagagaaaaaagggagtaggttgggggaaagccccagtctgagccgccaattttggggaagtggtctagctggttatataatcgctttagagggagaaggagggtgagcattgagcttgttcgattaagtgttttctgtgcagtcaaagccgaacgaaagtgtctgggataaagaaactacctgtgccaggtctatccttcgacctcaggagctgggcccccggtgtaattctgtcccgactgtggggtgtaaacacacgatgccacgcaggtgtagcaggagccatcgttagcgggcaatgtaatgacaacggaacgcagacctgggcaatgcgcgctgcgcccaaggggcaagcgagtggcagggtcgcttattctcccagtgctcggcgctcgcagacccggagccttccgcccagcgccctgtgtaggtagcgagtgtcgggagaaatcatcactacgaattcgtttccatataggggcaacgccaggcggggcacaatgatctgtccttgaggacaaagagtgattccggagagagcaggtttttgtccctccacgcaggtttctctccccagaccccagccttcggcttcctcccttcctgtcacggacgcagccggagaaactggggcccagacgcggagctcactccgccagaaaccctgggtcccttcccctacgctggcaggctgggtccggttccatcgtcgcggctccgtttatccctccagggagcgcgggcagagcgccgagcgcggcgcagggactggagttctcgccagcttcgggttctttctccccggagctgcccggggggtctcggcctcgggcgctcccgccgccgtcctgttcccctcagggttcatgtcctgttcccggggccccagaggtcccgtctgagagcggcccccgcgagcttgggtgtcgcggaaccaccgctgtcggaagccgaggttacacaaacgccacgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggtgaggcctggctgcgggggtagaggcagaaagggaacttcccctttcctcacagctcctggaggggaccaggagtctacaggttggtgctaagggagggccccagagcctcccccattctgtaaaagtgggaaactgagtccctaaggggacaaggccttgcccaaagtccccacagcgagggacagagatgagactagacttggtgtccagcgtccagtcagccct

SEQ ID NO: 131263 - DNA, 34 bp, Homo sapiens; identical to SEQ ID NO: 100544
  chr9:135463680-135463714
  Hyper

SEQ ID NO: 131264 - DNA, 262 bp, Homo sapiens; identical to SEQ ID NO: 100545
  chr9:135463992-135464254
  Hyper

SEQ ID NO: 131265 - DNA, 275 bp, Homo sapiens; identical to SEQ ID NO: 100546
  chr9:135464664-135464939
  Hyper

SEQ ID NO: 131266 - DNA, 1502 bp, Homo sapiens
  chr9:135465191-135466693
  Hyper
acccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccgggcgcgggccgacagatgggctccgaggctgctccccccatcactcccaccctccgcccagcgtccggccgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctcttctggctgccccagaccgcagctctagcatctcaggggagaggggtttaagtcccgagtcagactcgaggcttccagttcacgtccaaagggccacggtcacctgagactgctccctctctggggaggtgggcgcaggtgctcccttcccacacaccacctgcagctcgctaaccctcagcgctgggaagttttgggggccggcaagccgtggcccctctagtttgggggcagggtttctctgaagacgggggctgtgttcagactataacccctctcgaaaaccatacccacagccaggtccgctactgtttcctccctgccccgaaacaccctcgcacagcagctttc

SEQ ID NO: 131267 - DNA, 204 bp, Homo sapiens; identical to SEQ ID NO: 42260
  chr9:135512910-135513114
  Hypo

SEQ ID NO: 131268 - DNA, 86 bp, Homo sapiens; identical to SEQ ID NO: 100550
  chr9:135548179-135548265
  Hypo

SEQ ID NO: 131269 - DNA, 85 bp, Homo sapiens; identical to SEQ ID NO: 100551
  chr9:135548565-135548650
  Hypo

SEQ ID NO: 131270 - DNA, 38 bp, Homo sapiens; identical to SEQ ID NO: 100552
  chr9:135645212-135645250
  Hyper

SEQ ID NO: 131271 - DNA, 280 bp, Homo sapiens; identical to SEQ ID NO: 32783
  chr9:135645863-135646143
  Hyper

SEQ ID NO: 131272 - DNA, 74 bp, Homo sapiens; identical to SEQ ID NO: 42262
  chr9:135768018-135768092
  Hypo

SEQ ID NO: 131273 - DNA, 30 bp, Homo sapiens; identical to SEQ ID NO: 42263
  chr9:135833429-135833459
  Hypo

SEQ ID NO: 131274 - DNA, 188 bp, Homo sapiens; identical to SEQ ID NO: 100557
  chr9:135865042-135865230
  Hypo

SEQ ID NO: 131275 - DNA, 246 bp, Homo sapiens; identical to SEQ ID NO: 42265
  chr9:135898878-135899124
  Hypo

SEQ ID NO: 131276 - DNA, 56 bp, Homo sapiens; identical to SEQ ID NO: 42266
  chr9:135908143-135908199
  Hypo

SEQ ID NO: 131277 - DNA, 30 bp, Homo sapiens; identical to SEQ ID NO: 100560
  chr9:135909759-135909789
  Hypo

SEQ ID NO: 131278 - DNA, 107 bp, Homo sapiens; identical to SEQ ID NO: 100561
  chr9:136029028-136029135
  Hypo

SEQ ID NO: 131279 - DNA, 675 bp, Homo sapiens; identical to SEQ ID NO: 100562
  chr9:136038772-136039447
  Hyper

SEQ ID NO: 131280 - DNA, 30 bp, Homo sapiens; identical to SEQ ID NO: 100563
  chr9:136151457-136151487
  Hyper

SEQ ID NO: 131281 - DNA, 160 bp, Homo sapiens; identical to SEQ ID NO: 100564
  chr9:136375573-136375733
  Hypo

SEQ ID NO: 131282 - DNA, 90 bp, Homo sapiens; identical to SEQ ID NO: 100565
  chr9:136378429-136378519
  Hypo

SEQ ID NO: 131283 - DNA, 86 bp, Homo sapiens; identical to SEQ ID NO: 100566
  chr9:136383935-136384021
  Hypo

SEQ ID NO: 131284 - DNA, 30 bp, Homo sapiens; identical to SEQ ID NO: 100567
  chr9:136395929-136395959
  Hypo

SEQ ID NO: 131285 - DNA, 127 bp, Homo sapiens; identical to SEQ ID NO: 100568
  chr9:136399516-136399643
  Hyper

SEQ ID NO: 131286 - DNA, 94 bp, Homo sapiens; identical to SEQ ID NO: 100569
  chr9:136400112-136400206
  Hyper

SEQ ID NO: 131287 - DNA, 555 bp, Homo sapiens
  chr9:136474227-136474782
  Hyper
ccgcgaggacttgggcgcacgtgacggggcgggcgggcgtccgacccgggcagggcgcagctagcggcggccgctcatgcccaggccacggcggtggcgcctggtgtggctgggcgggcgaggcgggcgctgagaagcccgggaggcccccggggaggcgactgcgtgcccaggcgggcacccctgccagctccgcgctgcggccgcgactccggacgccccggctggctccctgcgagctgcacgcgcggctccagcctggtcccgagcgcagggcgcgcgctggcggggagggcgcgcgcccgagcctggcggggagcgcgcgtcaccggcccgcgcgcgcagtcgtcgggggatgccgggagcggcctggggagctgtccctggtgctgacggctcgtccgctctcgcccgggacgcgcgacctcctggaggcctgggggtgcccccaccctggccggcgccctgcggtgctccctccgctctccgcctgttctcggggcgttccggcttccacaacgttgggatctggagtcaggccgaagctgctgctta

SEQ ID NO: 131288 - DNA, 30 bp, Homo sapiens; identical to SEQ ID NO: 100573
  chr9:136477280-136477310
  Hypo

SEQ ID NO: 131289 - DNA, 59 bp, Homo sapiens; identical to SEQ ID NO: 100574
  chr9:136521608-136521667
  Hypo

SEQ ID NO: 131290 - DNA, 42 bp, Homo sapiens; identical to SEQ ID NO: 100575
  chr9:136527279-136527321
  Hypo

SEQ ID NO: 131291 - DNA, 123 bp, Homo sapiens; identical to SEQ ID NO: 100576
  chr9:136553113-136553236
  Hypo

SEQ ID NO: 131292 - DNA, 30 bp, Homo sapiens; identical to SEQ ID NO: 42270
  chr9:136559282-136559312
  Hypo

SEQ ID NO: 131293 - DNA, 188 bp, Homo sapiens; identical to SEQ ID NO: 100578
  chr9:136573297-136573485
  Hypo

SEQ ID NO: 131294 - DNA, 110 bp, Homo sapiens; identical to SEQ ID NO: 100579
  chr9:136603522-136603632
  Hyper

SEQ ID NO: 131295 - DNA, 112 bp, Homo sapiens; identical to SEQ ID NO: 100580
  chr9:136658252-136658364
  Hyper

SEQ ID NO: 131296 - DNA, 39 bp, Homo sapiens; identical to SEQ ID NO: 100581
  chr9:136708022-136708061
  Hypo

SEQ ID NO: 131297 - DNA, 30 bp, Homo sapiens; identical to SEQ ID NO: 100582
  chr9:136727495-136727525
  Hypo

SEQ ID NO: 131298 - DNA, 97 bp, Homo sapiens; identical to SEQ ID NO: 100583
  chr9:136728397-136728494
  Hypo

SEQ ID NO: 131299 - DNA, 53 bp, Homo sapiens; identical to SEQ ID NO: 100584
  chr9:136837620-136837673
  Hypo

SEQ ID NO: 131300 - DNA, 42 bp, Homo sapiens; identical to SEQ ID NO: 100585
  chr9:136860951-136860993
  Hypo

SEQ ID NO: 131301 - DNA, 178 bp, Homo sapiens; identical to SEQ ID NO: 100586
  chr9:136931060-136931238
  Hyper

SEQ ID NO: 131302 - DNA, 145 bp, Homo sapiens; identical to SEQ ID NO: 100587
  chr9:136990501-136990646
  Hypo

SEQ ID NO: 131303 - DNA, 30 bp, Homo sapiens; identical to SEQ ID NO: 15265
  chr9:136999528-136999558
  Hypo

SEQ ID NO: 131304 - DNA, 32 bp, Homo sapiens; identical to SEQ ID NO: 100589
  chr9:137024169-137024201
  Hypo

SEQ ID NO: 131305 - DNA, 151 bp, Homo sapiens; identical to SEQ ID NO: 100590
  chr9:137248217-137248368
  Hypo

SEQ ID NO: 131306 - DNA, 126 bp, Homo sapiens; identical to SEQ ID NO: 100591
  chr9:137281012-137281138
  Hypo

SEQ ID NO: 131307 - DNA, 39 bp, Homo sapiens; identical to SEQ ID NO: 32791
  chr9:137295661-137295700
  Hyper

SEQ ID NO: 131308 - DNA, 456 bp, Homo sapiens; identical to SEQ ID NO: 100593
  chr9:137299119-137299575
  Hyper

SEQ ID NO: 131309 - DNA, 30 bp, Homo sapiens; identical to SEQ ID NO: 100594
  chr9:137306458-137306488
  Hypo

SEQ ID NO: 131310 - DNA, 30 bp, Homo sapiens; identical to SEQ ID NO: 100595
  chr9:137312093-137312123
  Hypo

SEQ ID NO: 131311 - DNA, 42 bp, Homo sapiens; identical to SEQ ID NO: 100596
  chr9:137312331-137312373
  Hypo

SEQ ID NO: 131312 - DNA, 33 bp, Homo sapiens; identical to SEQ ID NO: 100597
  chr9:137312923-137312956
  Hypo

SEQ ID NO: 131313 - DNA, 30 bp, Homo sapiens; identical to SEQ ID NO: 100598
  chr9:137328381-137328411
  Hypo

SEQ ID NO: 131314 - DNA, 48 bp, Homo sapiens; identical to SEQ ID NO: 100599
  chr9:137386151-137386199
  Hypo

SEQ ID NO: 131315 - DNA, 46 bp, Homo sapiens; identical to SEQ ID NO: 100600
  chr9:137427038-137427084
  Hypo

SEQ ID NO: 131316 - DNA, 30 bp, Homo sapiens; identical to SEQ ID NO: 100601
  chr9:137439116-137439146
  Hypo

SEQ ID NO: 131317 - DNA, 195 bp, Homo sapiens; identical to SEQ ID NO: 100602
  chr9:137457365-137457560
  Hypo

SEQ ID NO: 131318 - DNA, 87 bp, Homo sapiens; identical to SEQ ID NO: 100603
  chr9:137489165-137489252
  Hypo

SEQ ID NO: 131319 - DNA, 195 bp, Homo sapiens; identical to SEQ ID NO: 100604
  chr9:137519751-137519946
  Hypo

SEQ ID NO: 131320 - DNA, 30 bp, Homo sapiens; identical to SEQ ID NO: 32793
  chr9:137533003-137533033
  Hyper

SEQ ID NO: 131321 - DNA, 1062 bp, Homo sapiens
  chr9:137533496-137534558
  Hyper
gcgcccagtgggaggcgggggctggcctcgccgagcccagcgccgggctctgatttgctgcgggcgttggggatcgacagcctccgcggctgccttccaggagagagggagggaggaaaagggggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcaggtaagggcgccccggggcgcggggctgcgggatggggcgcgcgcagcccgggcgccgctgtcatccccgggcgccttcgcccgcagaacttttcttccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagtta

SEQ ID NO: 131322 - DNA, 90 bp, Homo sapiens; identical to SEQ ID NO: 100608
  chr9:137539456-137539546
  Hypo

SEQ ID NO: 131323 - DNA, 180 bp, Homo sapiens; identical to SEQ ID NO: 100609
  chr9:137580727-137580907
  Hypo

SEQ ID NO: 131324 - DNA, 30 bp, Homo sapiens; identical to SEQ ID NO: 100610
  chr9:137601900-137601930
  Hypo

SEQ ID NO: 131325 - DNA, 35 bp, Homo sapiens; identical to SEQ ID NO: 42278
  chr9:137602268-137602303
  Hypo

SEQ ID NO: 131326 - DNA, 34 bp, Homo sapiens; identical to SEQ ID NO: 100612
  chr9:137602975-137603009
  Hypo

SEQ ID NO: 131327 - DNA, 48 bp, Homo sapiens; identical to SEQ ID NO: 100613
  chr9:137609353-137609401
  Hypo

SEQ ID NO: 131328 - DNA, 36 bp, Homo sapiens; identical to SEQ ID NO: 100614
  chr9:137616322-137616358
  Hypo

SEQ ID NO: 131329 - DNA, 33 bp, Homo sapiens; identical to SEQ ID NO: 100615
  chr9:137616641-137616674
  Hypo

SEQ ID NO: 131330 - DNA, 192 bp, Homo sapiens; identical to SEQ ID NO: 100616
  chr9:137623351-137623543
  Hypo

SEQ ID NO: 131331 - DNA, 184 bp, Homo sapiens; identical to SEQ ID NO: 100617
  chr9:137624178-137624362
  Hypo

SEQ ID NO: 131332 - DNA, 30 bp, Homo sapiens; identical to SEQ ID NO: 42280
  chr9:137631987-137632017
  Hypo

SEQ ID NO: 131333 - DNA, 51 bp, Homo sapiens; identical to SEQ ID NO: 100619
  chr9:137638944-137638995
  Hypo

SEQ ID NO: 131334 - DNA, 30 bp, Homo sapiens; identical to SEQ ID NO: 100620
  chr9:137650802-137650832
  Hypo

SEQ ID NO: 131335 - DNA, 30 bp, Homo sapiens; identical to SEQ ID NO: 100621
  chr9:137652857-137652887
  Hypo

SEQ ID NO: 131336 - DNA, 233 bp, Homo sapiens; identical to SEQ ID NO: 100622
  chr9:137656918-137657151
  Hypo

SEQ ID NO: 131337 - DNA, 125 bp, Homo sapiens; identical to SEQ ID NO: 100623
  chr9:137667232-137667357
  Hypo

SEQ ID NO: 131338 - DNA, 30 bp, Homo sapiens; identical to SEQ ID NO: 100624
  chr9:137674975-137675005
  Hypo

SEQ ID NO: 131339 - DNA, 35 bp, Homo sapiens; identical to SEQ ID NO: 42284
  chr9:137685677-137685712
  Hypo

SEQ ID NO: 131340 - DNA, 165 bp, Homo sapiens; identical to SEQ ID NO: 100626
  chr9:137687742-137687907
  Hypo

SEQ ID NO: 131341 - DNA, 381 bp, Homo sapiens; identical to SEQ ID NO: 100627
  chr9:137694270-137694651
  Hypo

SEQ ID NO: 131342 - DNA, 30 bp, Homo sapiens; identical to SEQ ID NO: 100628
  chr9:137696349-137696379
  Hypo

SEQ ID NO: 131343 - DNA, 30 bp, Homo sapiens; identical to SEQ ID NO: 100629
  chr9:137698436-137698466
  Hypo

SEQ ID NO: 131344 - DNA, 30 bp, Homo sapiens; identical to SEQ ID NO: 100630
  chr9:137701048-137701078
  Hypo

SEQ ID NO: 131345 - DNA, 30 bp, Homo sapiens; identical to SEQ ID NO: 100631
  chr9:137703099-137703129
  Hypo

SEQ ID NO: 131346 - DNA, 397 bp, Homo sapiens; identical to SEQ ID NO: 100632
  chr9:137710195-137710592
  Hypo

SEQ ID NO: 131347 - DNA, 40 bp, Homo sapiens; identical to SEQ ID NO: 100633
  chr9:137711094-137711134
  Hypo

SEQ ID NO: 131348 - DNA, 198 bp, Homo sapiens; identical to SEQ ID NO: 100634
  chr9:137716801-137716999
  Hypo

SEQ ID NO: 131349 - DNA, 264 bp, Homo sapiens; identical to SEQ ID NO: 100635
  chr9:137718850-137719114
  Hypo

SEQ ID NO: 131350 - DNA, 300 bp, Homo sapiens; identical to SEQ ID NO: 100636
  chr9:137719318-137719618
  Hypo

SEQ ID NO: 131351 - DNA, 30 bp, Homo sapiens; identical to SEQ ID NO: 100637
  chr9:137720183-137720213
  Hypo

SEQ ID NO: 131352 - DNA, 63 bp, Homo sapiens; identical to SEQ ID NO: 100638
  chr9:137721214-137721277
  Hypo

SEQ ID NO: 131353 - DNA, 161 bp, Homo sapiens; identical to SEQ ID NO: 100639
  chr9:137721661-137721822
  Hypo

SEQ ID NO: 131354 - DNA, 41 bp, Homo sapiens; identical to SEQ ID NO: 100640
  chr9:137722056-137722097
  Hypo

SEQ ID NO: 131355 - DNA, 156 bp, Homo sapiens; identical to SEQ ID NO: 100641
  chr9:137724524-137724680
  Hypo

SEQ ID NO: 131356 - DNA, 69 bp, Homo sapiens; identical to SEQ ID NO: 100642
  chr9:137726887-137726956
  Hypo

SEQ ID NO: 131357 - DNA, 45 bp, Homo sapiens; identical to SEQ ID NO: 100643
  chr9:137730826-137730871
  Hypo

SEQ ID NO: 131358 - DNA, 33 bp, Homo sapiens; identical to SEQ ID NO: 100644
  chr9:137731553-137731586
  Hypo

SEQ ID NO: 131359 - DNA, 30 bp, Homo sapiens; identical to SEQ ID NO: 100645
  chr9:137731848-137731878
  Hypo

SEQ ID NO: 131360 - DNA, 60 bp, Homo sapiens; identical to SEQ ID NO: 42294
  chr9:137734084-137734144
  Hypo

SEQ ID NO: 131361 - DNA, 30 bp, Homo sapiens; identical to SEQ ID NO: 100647
  chr9:137747704-137747734
  Hypo

SEQ ID NO: 131362 - DNA, 30 bp, Homo sapiens; identical to SEQ ID NO: 100648
  chr9:137771562-137771592
  Hypo

SEQ ID NO: 131363 - DNA, 30 bp, Homo sapiens; identical to SEQ ID NO: 100649
  chr9:137771832-137771862
  Hypo

SEQ ID NO: 131364 - DNA, 30 bp, Homo sapiens; identical to SEQ ID NO: 100650
  chr9:137774917-137774947
  Hypo

SEQ ID NO: 131365 - DNA, 30 bp, Homo sapiens; identical to SEQ ID NO: 100651
  chr9:137777607-137777637
  Hypo

SEQ ID NO: 131366 - DNA, 30 bp, Homo sapiens; identical to SEQ ID NO: 100652
  chr9:137804943-137804973
  Hypo

SEQ ID NO: 131367 - DNA, 33 bp, Homo sapiens; identical to SEQ ID NO: 100653
  chr9:137805825-137805858
  Hypo

SEQ ID NO: 131368 - DNA, 30 bp, Homo sapiens; identical to SEQ ID NO: 100654
  chr9:137832202-137832232
  Hypo

SEQ ID NO: 131369 - DNA, 30 bp, Homo sapiens; identical to SEQ ID NO: 100655
  chr9:137840749-137840779
  Hypo

SEQ ID NO: 131370 - DNA, 30 bp, Homo sapiens; identical to SEQ ID NO: 42295
  chr9:137851369-137851399
  Hypo

SEQ ID NO: 131371 - DNA, 576 bp, Homo sapiens; identical to SEQ ID NO: 100657
  chr9:137854764-137855340
  Hypo

SEQ ID NO: 131372 - DNA, 163 bp, Homo sapiens; identical to SEQ ID NO: 100658
  chr9:137865081-137865244
  Hypo

SEQ ID NO: 131373 - DNA, 30 bp, Homo sapiens; identical to SEQ ID NO: 100659
  chr9:137901149-137901179
  Hypo

SEQ ID NO: 131374 - DNA, 30 bp, Homo sapiens; identical to SEQ ID NO: 100660
  chr9:137937191-137937221
  Hypo

SEQ ID NO: 131375 - DNA, 30 bp, Homo sapiens; identical to SEQ ID NO: 100661
  chr9:137937533-137937563
  Hypo

SEQ ID NO: 131376 - DNA, 737 bp, Homo sapiens
  chr9:137967194-137967931
  Hyper
acttttggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtacgtgcatccaacgccattttcctccctgccaggcgcccggcccggcccctcgggagccccacaaagtccgggaacggctctggctccgcgccgccccgcgcccccggcctgggcgcccgaagtgccggggttggggagggggccagggcgctaggctggacctgggtgggagggaggggtgcaggctgaccggagacggcgctcctccagccccggctcagcagagctgacagctgccccctttttcctaggactccgctgcccccgactccctgctgag

SEQ ID NO: 131377 - DNA, 30 bp, Homo sapiens; identical to SEQ ID NO: 100665
  chr9:137977952-137977982
  Hyper

SEQ ID NO: 131378 - DNA, 126 bp, Homo sapiens; identical to SEQ ID NO: 100666
  chr9:137978937-137979063
  Hyper

SEQ ID NO: 131379 - DNA, 1533 bp, Homo sapiens
  chr9:137979475-137981008
  Hyper
cccggccgcggcccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccggcgcagcggtggcgaccctgctccccgctcccccagcctgggccactccatctccgcccgcgcgcccctggggcggcgtttccttcgtctgggcccctcgccgcggggccgggggagcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgtggtgtggctccctcctaagacccctcttgaggccgccctccctgctcc

SEQ ID NO: 131380 - DNA, 30 bp, Homo sapiens; identical to SEQ ID NO: 100669
  chr9:138054641-138054671
  Hypo

SEQ ID NO: 131381 - DNA, 30 bp, Homo sapiens; identical to SEQ ID NO: 100670
  chr9:138080405-138080435
  Hypo

SEQ ID NO: 131382 - DNA, 30 bp, Homo sapiens; identical to SEQ ID NO: 100671
  chr9:138131370-138131400
  Hypo

SEQ ID NO: 131383 - DNA, 30 bp, Homo sapiens; identical to SEQ ID NO: 100672
  chr9:138133678-138133708
  Hypo

SEQ ID NO: 131384 - DNA, 173 bp, Homo sapiens; identical to SEQ ID NO: 100673
  chr9:138218634-138218807
  Hypo

SEQ ID NO: 131385 - DNA, 155 bp, Homo sapiens; identical to SEQ ID NO: 100674
  chr9:138265117-138265272
  Hypo

SEQ ID NO: 131386 - DNA, 142 bp, Homo sapiens; identical to SEQ ID NO: 100675
  chr9:138270882-138271024
  Hypo

SEQ ID NO: 131387 - DNA, 30 bp, Homo sapiens; identical to SEQ ID NO: 100676
  chr9:138275014-138275044
  Hypo

SEQ ID NO: 131388 - DNA, 64 bp, Homo sapiens; identical to SEQ ID NO: 100677
  chr9:138288949-138289013
  Hypo

SEQ ID NO: 131389 - DNA, 438 bp, Homo sapiens; identical to SEQ ID NO: 100678
  chr9:138289352-138289790
  Hypo

SEQ ID NO: 131390 - DNA, 30 bp, Homo sapiens; identical to SEQ ID NO: 42299
  chr9:138290031-138290061
  Hypo

SEQ ID NO: 131391 - DNA, 30 bp, Homo sapiens; identical to SEQ ID NO: 100680
  chr9:138339327-138339357
  Hypo

SEQ ID NO: 131392 - DNA, 30 bp, Homo sapiens; identical to SEQ ID NO: 100681
  chr9:138354047-138354077
  Hypo

SEQ ID NO: 131393 - DNA, 30 bp, Homo sapiens; identical to SEQ ID NO: 100682
  chr9:138388283-138388313
  Hypo

SEQ ID NO: 131394 - DNA, 242 bp, Homo sapiens; identical to SEQ ID NO: 100683
  chr9:138393554-138393796
  Hypo

SEQ ID NO: 131395 - DNA, 146 bp, Homo sapiens; identical to SEQ ID NO: 100684
  chr9:138416374-138416520
  Hypo

SEQ ID NO: 131396 - DNA, 48 bp, Homo sapiens; identical to SEQ ID NO: 100685
  chr9:138444796-138444844
  Hypo

SEQ ID NO: 131397 - DNA, 237 bp, Homo sapiens; identical to SEQ ID NO: 100686
  chr9:138506017-138506254
  Hypo

SEQ ID NO: 131398 - DNA, 30 bp, Homo sapiens; identical to SEQ ID NO: 100687
  chr9:138508740-138508770
  Hypo

SEQ ID NO: 131399 - DNA, 176 bp, Homo sapiens; identical to SEQ ID NO: 100688
  chr9:138557647-138557823
  Hypo

SEQ ID NO: 131400 - DNA, 586 bp, Homo sapiens; identical to SEQ ID NO: 100689
  chr9:138562694-138563280
  Hypo

SEQ ID NO: 131401 - DNA, 78 bp, Homo sapiens; identical to SEQ ID NO: 100690
  chr9:138577356-138577434
  Hypo

SEQ ID NO: 131402 - DNA, 235 bp, Homo sapiens; identical to SEQ ID NO: 100691
  chr9:138577643-138577878
  Hypo

SEQ ID NO: 131403 - DNA, 30 bp, Homo sapiens; identical to SEQ ID NO: 42308
  chr9:138587151-138587181
  Hypo

SEQ ID NO: 131404 - DNA, 30 bp, Homo sapiens; identical to SEQ ID NO: 100693
  chr9:138590884-138590914
  Hypo

SEQ ID NO: 131405 - DNA, 36 bp, Homo sapiens; identical to SEQ ID NO: 100694
  chr9:138591435-138591471
  Hypo

SEQ ID NO: 131406 - DNA, 30 bp, Homo sapiens; identical to SEQ ID NO: 42310
  chr9:138598276-138598306
  Hypo

SEQ ID NO: 131407 - DNA, 611 bp, Homo sapiens
  chr9:138606154-138606765
  Hyper
cctcctgccaggccccggggccgctttggagggagccccgccccctgcccctgcgcagcccccgccctagccccagcccggcgcagccggtcccgcgcgcccccgcccgcatgtgccgccaggcccgcccccgcccggccgcccgcccgcccggtgggtcgcggtggccgcgggctgcgctgcgcgggccgggcctggcgggccgggggctgcgcgcgtccgcgagggcgcccgacgcgggctgaggggcgctggcgtgtgcccgcaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacaggtagggaccgggcgcggggtgggggctggggtcgccgtcccggcgccgccgcacgcccggagctgtccgcggtgctgacggccggtcccgcgcgcccccgcagccgccggcgcccttcaacttttcccggcttctggggacgcagaagtttcggagggggtgcgggcagggggaagcatcttctcgggagggggtctcc

SEQ ID NO: 131408 - DNA, 46 bp, Homo sapiens; identical to SEQ ID NO: 100698
  chr9:138607023-138607069
  Hyper

SEQ ID NO: 131409 - DNA, 30 bp, Homo sapiens; identical to SEQ ID NO: 100699
  chr9:138610744-138610774
  Hypo

SEQ ID NO: 131410 - DNA, 30 bp, Homo sapiens; identical to SEQ ID NO: 100700
  chr9:138617193-138617223
  Hypo

SEQ ID NO: 131411 - DNA, 45 bp, Homo sapiens; identical to SEQ ID NO: 100701
  chr9:138627005-138627050
  Hypo

SEQ ID NO: 131412 - DNA, 234 bp, Homo sapiens; identical to SEQ ID NO: 100702
  chr9:138627598-138627832
  Hypo

SEQ ID NO: 131413 - DNA, 676 bp, Homo sapiens; identical to SEQ ID NO: 100703
  chr9:138628067-138628743
  Hyper

SEQ ID NO: 131414 - DNA, 189 bp, Homo sapiens; identical to SEQ ID NO: 100704
  chr9:138634034-138634223
  Hypo

SEQ ID NO: 131415 - DNA, 41 bp, Homo sapiens; identical to SEQ ID NO: 100705
  chr9:138636443-138636484
  Hypo

SEQ ID NO: 131416 - DNA, 46 bp, Homo sapiens; identical to SEQ ID NO: 100706
  chr9:138637140-138637186
  Hypo

SEQ ID NO: 131417 - DNA, 168 bp, Homo sapiens; identical to SEQ ID NO: 100707
  chr9:138637881-138638049
  Hypo

SEQ ID NO: 131418 - DNA, 92 bp, Homo sapiens; identical to SEQ ID NO: 100708
  chr9:138642834-138642926
  Hypo

SEQ ID NO: 131419 - DNA, 144 bp, Homo sapiens; identical to SEQ ID NO: 100709
  chr9:138650083-138650227
  Hypo

SEQ ID NO: 131420 - DNA, 30 bp, Homo sapiens; identical to SEQ ID NO: 42316
  chr9:138651295-138651325
  Hypo

SEQ ID NO: 131421 - DNA, 167 bp, Homo sapiens; identical to SEQ ID NO: 100711
  chr9:138651534-138651701
  Hypo

SEQ ID NO: 131422 - DNA, 30 bp, Homo sapiens; identical to SEQ ID NO: 100712
  chr9:138653799-138653829
  Hypo

SEQ ID NO: 131423 - DNA, 169 bp, Homo sapiens; identical to SEQ ID NO: 100713
  chr9:138655771-138655940
  Hypo

SEQ ID NO: 131424 - DNA, 240 bp, Homo sapiens; identical to SEQ ID NO: 42319
  chr9:138659727-138659967
  Hypo

SEQ ID NO: 131425 - DNA, 1191 bp, Homo sapiens; identical to SEQ ID NO: 100715
  chr9:138660771-138661962
  Hypo

SEQ ID NO: 131426 - DNA, 41 bp, Homo sapiens; identical to SEQ ID NO: 100716
  chr9:138662644-138662685
  Hypo

SEQ ID NO: 131427 - DNA, 222 bp, Homo sapiens; identical to SEQ ID NO: 100717
  chr9:138666427-138666649
  Hypo

SEQ ID NO: 131428 - DNA, 127 bp, Homo sapiens; identical to SEQ ID NO: 100718
  chr9:138670651-138670778
  Hypo

SEQ ID NO: 131429 - DNA, 125 bp, Homo sapiens; identical to SEQ ID NO: 100719
  chr9:138671163-138671288
  Hypo

SEQ ID NO: 131430 - DNA, 84 bp, Homo sapiens; identical to SEQ ID NO: 100720
  chr9:138675763-138675847
  Hypo

SEQ ID NO: 131431 - DNA, 60 bp, Homo sapiens; identical to SEQ ID NO: 100721
  chr9:138678104-138678164
  Hypo

SEQ ID NO: 131432 - DNA, 89 bp, Homo sapiens; identical to SEQ ID NO: 100722
  chr9:138678379-138678468
  Hypo

SEQ ID NO: 131433 - DNA, 30 bp, Homo sapiens; identical to SEQ ID NO: 100723
  chr9:138679557-138679587
  Hypo

SEQ ID NO: 131434 - DNA, 97 bp, Homo sapiens; identical to SEQ ID NO: 100724
  chr9:138680008-138680105
  Hypo

SEQ ID NO: 131435 - DNA, 156 bp, Homo sapiens; identical to SEQ ID NO: 100725
  chr9:138688832-138688988
  Hypo

SEQ ID NO: 131436 - DNA, 182 bp, Homo sapiens; identical to SEQ ID NO: 100726
  chr9:138743697-138743879
  Hypo

SEQ ID NO: 131437 - DNA, 284 bp, Homo sapiens; identical to SEQ ID NO: 42327
  chr9:138780586-138780870
  Hypo

SEQ ID NO: 131438 - DNA, 30 bp, Homo sapiens; identical to SEQ ID NO: 42328
  chr9:138781904-138781934
  Hypo

SEQ ID NO: 131439 - DNA, 17 bp, Homo sapiens
  chr9:138812042-138812059
  Hypo
ggcgggaggattgcttt

SEQ ID NO: 131440 - DNA, 58 bp, Homo sapiens; identical to SEQ ID NO: 100730
  chr9:138813127-138813185
  Hypo

SEQ ID NO: 131441 - DNA, 32 bp, Homo sapiens; identical to SEQ ID NO: 100731
  chr9:138825931-138825963
  Hypo

SEQ ID NO: 131442 - DNA, 323 bp, Homo sapiens; identical to SEQ ID NO: 100732
  chr9:138831815-138832138
  Hypo

SEQ ID NO: 131443 - DNA, 139 bp, Homo sapiens; identical to SEQ ID NO: 100733
  chr9:138851512-138851651
  Hypo

SEQ ID NO: 131444 - DNA, 124 bp, Homo sapiens; identical to SEQ ID NO: 100734
  chr9:138873414-138873538
  Hypo

SEQ ID NO: 131445 - DNA, 30 bp, Homo sapiens; identical to SEQ ID NO: 100735
  chr9:138880956-138880986
  Hypo

SEQ ID NO: 131446 - DNA, 51 bp, Homo sapiens; identical to SEQ ID NO: 100736
  chr9:138970797-138970848
  Hypo

SEQ ID NO: 131447 - DNA, 30 bp, Homo sapiens; identical to SEQ ID NO: 100737
  chr9:138986039-138986069
  Hyper

SEQ ID NO: 131448 - DNA, 61 bp, Homo sapiens; identical to SEQ ID NO: 100738
  chr9:138986272-138986333
  Hyper

SEQ ID NO: 131449 - DNA, 76 bp, Homo sapiens; identical to SEQ ID NO: 100739
  chr9:138991914-138991990
  Hypo

SEQ ID NO: 131450 - DNA, 87 bp, Homo sapiens; identical to SEQ ID NO: 42332
  chr9:138994353-138994440
  Hypo

SEQ ID NO: 131451 - DNA, 275 bp, Homo sapiens; identical to SEQ ID NO: 100741
  chr9:139000396-139000671
  Hypo

SEQ ID NO: 131452 - DNA, 234 bp, Homo sapiens; identical to SEQ ID NO: 100742
  chr9:139012272-139012506
  Hypo

SEQ ID NO: 131453 - DNA, 576 bp, Homo sapiens
  chr9:139024359-139024935
  Hyper
ctccccttcccactgcgcccccgcgtccctgcagccaggggtgcgcgccccgccgcccagtcctgggatggagctgggaaacgcccgctgcggggtgcctgggacccccgaaggcgtcgggagttgggggcaaacggccgccgccggcccgcgtcaggcgcccggcctcgctggggccgcggctcggctgggtccccccactccgggtccggctgaatctccatcctccctgtgcggctcctgcaccccggcgaacctggctctctctgtgcctcagtttactcctgaggtccgctgagcaggaagtgcagccctggctccgggacctcagcccgaggccggcgctgctgcggagcacaggcctcctgaggccgccccacgcgcaggggcgctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcgcagggtcccccgcgccccagagcctgccccgcccctacgccggt

SEQ ID NO: 131454 - DNA, 175 bp, Homo sapiens; identical to SEQ ID NO: 100745
  chr9:139025288-139025463
  Hyper

SEQ ID NO: 131455 - DNA, 62 bp, Homo sapiens; identical to SEQ ID NO: 100746
  chr9:139025663-139025725
  Hyper

SEQ ID NO: 131456 - DNA, 113 bp, Homo sapiens; identical to SEQ ID NO: 100747
  chr9:139030628-139030741
  Hyper

SEQ ID NO: 131457 - DNA, 241 bp, Homo sapiens; identical to SEQ ID NO: 100748
  chr9:139045484-139045725
  Hypo

SEQ ID NO: 131458 - DNA, 173 bp, Homo sapiens; identical to SEQ ID NO: 100749
  chr9:139047509-139047682
  Hypo

SEQ ID NO: 131459 - DNA, 30 bp, Homo sapiens; identical to SEQ ID NO: 100750
  chr9:139068966-139068996
  Hypo

SEQ ID NO: 131460 - DNA, 39 bp, Homo sapiens; identical to SEQ ID NO: 100751
  chr9:139069965-139070004
  Hypo

SEQ ID NO: 131461 - DNA, 147 bp, Homo sapiens; identical to SEQ ID NO: 100752
  chr9:139077555-139077702
  Hypo

SEQ ID NO: 131462 - DNA, 156 bp, Homo sapiens; identical to SEQ ID NO: 100753
  chr9:139078945-139079101
  Hypo

SEQ ID NO: 131463 - DNA, 1613 bp, Homo sapiens
  chr9:139084546-139086159
  Hyper
tgccacccccagccccgcccccgctgcaagggggatggggtcctgggcaagggtcggtcctctctggtcagcgaccccgctgcctctcgggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctgattctgggttcgccctcgcgggtacggagcaggagccggaggaggtcggagcccgcgtttctgtccctggggcgcggggaggtcacagggctccccccaggcccgcgcggggcggaaccgggtacggccagagcggcgcgcgctgcgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgcgccgccagctggagcgggcgcgggcggggtccccgcgggaacagtcggcactttattaacctgtcagcgcctaaaaggtcccgggcggcctgggggaggggccggaggccggggcggggtgggggcgcggctgggggatttgcgccccctcctcggggctgccccccgccagcccgcgctgcaccccggcggccgcgccccctccctaaattccgccttcgacctgggcccggagccgctttccccgcgggctgcccgttgcccccggagagttcggggtcgtccctccagcgcccgtccctggccgcggggccgctggctggagtctctgccctggggacaccgactccgcaggccggccccgaacctcgcactttcccgccggcgcgcctttgcccgcactggtcgccgtcgccacgcgccatcctcgcgtccaaccccatctgcttccacgctcggctccagtgttgccgccattcccagtggccgtcggggcccttctcccctcccgggaccgccctggtgatccgcgcgtctctgcgcttcccaggggtgctcggtgcctccttagacacagcgtggctgccagagcctgggggtcgaaggccatgcgccacagggaggga

SEQ ID NO: 131464 - DNA, 531 bp, Homo sapiens; identical to SEQ ID NO: 100757
  chr9:139089100-139089631
  Hyper

SEQ ID NO: 131465 - DNA, 1259 bp, Homo sapiens
  chr9:139090405-139091664
  Hyper
tgggaaattcagatccgcgggctccctgggacccctgcgaccccgccgacgcgcgctcgtccccccccgagctccgcgatccctccgcctaccggggaaggagacctcagcgtcgctgtcctgcccctcctgaacgctgtccttgtccgacttggagccgccgcgggagcgcttcatgttgcggaaatactgcccccagcgctgccggccggcgtccttcttcagcctcttctccttggcccggcggttctggaaccaaacctgggggcggggcggggtgagcggccgcccggctctgcgggggcccccaaggccgcgggcgggagggaagcaggggcgagcgctgacctgcaccacgcgcatgtccaggcccgtctcggacgagagctgctcgcgcacgtggcgcgccggcttgggcgaggtgttgtaagcgctcttcagcgtctccagctgcttggcggtgatggtcgtgcgcggccgcttggccgtggcctcggcctctgcgcggcgggcgagcggtgaggcgcggcagcccctccggccccggccggacccccagccctcccaccccggccggcgcggggacgtcggggcctcaggtgcccacccccatcccgccccacaggcttctcggaaggcgcgggcgctgggagcgattggcaaaaacgggcagcacccgggctggggtggagggggcgccggcggagggcgggttctgccgcgggggcgggggcggcgccttccctaaaatcgcacctccacggcgcccccgccttcagccttggctcccttctccaagcaccctgatttccccgcgggctcccctttattctaagggtgtgggtatggcccagccttcgcggccaagaatttagggcgataattccgaccaggggcgaaaagccgcacacttcggaccgaacgaagcggttcgggacgcgggtctgtccgtgactccgccgttcccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacctcgctgcttggcggtttcgtagtccgccttgcacacgagccggctgtcctccatgaggtagaactcgtcgcccgtggccagctgccgcttgcacacgacgcaggcaaagcagtgcaggtggtacacgaagtcctgggcgc

SEQ ID NO: 131466 - DNA, 665 bp, Homo sapiens
  chr9:139093534-139094199
  Hyper
aggaaggggctccctcgacctccggcggaaaaaactgggctgcgcctccccacgcagtggcgggaaaccggcgatgaatgcgccccgcatccggcaaaaccgcagctccgggtgcggagcgtcgaggacccgctgcgcgcccggggtccccatcgtgggcagcgatcgcaggcgaggacccggctcggagcggggcggcccgacaggccgacacagcgcggattcagcaccgcggaccggacagcgcctcggccgcagctcgccgccggcgcccgcgtcgggcaaaagccgccccagcccaccccgcgccgcgcccgcgaccccagccttacgctgcatggcgactccagccctggcgggggctcctgtgtcagggatggcggggtcggcggagcctggacgccagcccgcccgctccggccagctctcccgagcgcgggcgcgcagtcctccttcctccctccctctctccgccccccagcccccgcggccaacccctcccaggaaccgtcgaaaaataaataaataagtagggaaccgcgagcccccacagcctggatgtaacccccttcccgccggccggtccctctcactccccactggctccggggcctccttccccatcctgcggctccagctggcccgggagtcgaggagaactgccc

SEQ ID NO: 131467 - DNA, 850 bp, Homo sapiens
  chr9:139094635-139095485
  Hyper
aaatacaggctgaggcgcccaggcgcggacgttccggggtcctcgcgcccactcccgcccagatcctctagctcctgccagcctccgcggccaggcccggaaaggcctgaggatctcctggtctccccggtgcagccactcggcccgggcacccacctcggcgcaggtccgccctccgcgccagcagtgctagcagcaggtcgcctcccgccgactcccgggccgggcccagctccccgcgcgcctccatgggtcccgccgcccggcgtcgccactctccagtcccgaactttcccgggcccagcgacgccaccccgcaatagccccgaaccggcgtccaagcgactccgggtgctgctgggcgctgcgcccgcgggccgccctggggcccggagcctctggccgagcggagggcggagcggccggggggcggggccgcggggcggggcggggccgggggtcgcggagaccagcccgggccactgcggactctgagcgcctttgcgccgggacctgcggtgcccagaggccgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccgatcccagatgcta

SEQ ID NO: 131468 - DNA, 637 bp, Homo sapiens; identical to SEQ ID NO: 100766
  chr9:139096558-139097195
  Hyper

SEQ ID NO: 131469 - DNA, 249 bp, Homo sapiens; identical to SEQ ID NO: 100767
  chr9:139100373-139100622
  Hypo

SEQ ID NO: 131470 - DNA, 113 bp, Homo sapiens; identical to SEQ ID NO: 100768
  chr9:139103518-139103631
  Hypo

SEQ ID NO: 131471 - DNA, 223 bp, Homo sapiens; identical to SEQ ID NO: 100769
  chr9:139111161-139111384
  Hypo

SEQ ID NO: 131472 - DNA, 30 bp, Homo sapiens; identical to SEQ ID NO: 100770
  chr9:139114451-139114481
  Hypo

SEQ ID NO: 131473 - DNA, 55 bp, Homo sapiens; identical to SEQ ID NO: 100771
  chr9:139133128-139133183
  Hypo

SEQ ID NO: 131474 - DNA, 161 bp, Homo sapiens; identical to SEQ ID NO: 100772
  chr9:139265268-139265429
  Hypo

SEQ ID NO: 131475 - DNA, 90 bp, Homo sapiens; identical to SEQ ID NO: 100773
  chr9:139268822-139268912
  Hypo

SEQ ID NO: 131476 - DNA, 212 bp, Homo sapiens; identical to SEQ ID NO: 100774
  chr9:139317654-139317866
  Hypo

SEQ ID NO: 131477 - DNA, 40 bp, Homo sapiens; identical to SEQ ID NO: 100775
  chr9:139367918-139367958
  Hypo

SEQ ID NO: 131478 - DNA, 31 bp, Homo sapiens; identical to SEQ ID NO: 100776
  chr9:139375341-139375372
  Hypo

SEQ ID NO: 131479 - DNA, 28 bp, Homo sapiens
  chr9:139375871-139375899
  Hypo
gagccaccgcgcccggcccagggaattt

SEQ ID NO: 131480 - DNA, 57 bp, Homo sapiens; identical to SEQ ID NO: 100778
  chr9:139403416-139403473
  Hypo

SEQ ID NO: 131481 - DNA, 30 bp, Homo sapiens; identical to SEQ ID NO: 42346
  chr9:139412504-139412534
  Hypo

SEQ ID NO: 131482 - DNA, 30 bp, Homo sapiens; identical to SEQ ID NO: 42347
  chr9:139419942-139419972
  Hypo

SEQ ID NO: 131483 - DNA, 229 bp, Homo sapiens; identical to SEQ ID NO: 100781
  chr9:139421894-139422123
  Hypo

SEQ ID NO: 131484 - DNA, 127 bp, Homo sapiens; identical to SEQ ID NO: 100782
  chr9:139471982-139472109
  Hypo

SEQ ID NO: 131485 - DNA, 40 bp, Homo sapiens; identical to SEQ ID NO: 15284
  chr9:139472499-139472539
  Hypo

SEQ ID NO: 131486 - DNA, 30 bp, Homo sapiens
  chr9:139482802-139482832
  Hyper
gggcgatgggagcagcggaggagcccaggc

SEQ ID NO: 131487 - DNA, 30 bp, Homo sapiens; identical to SEQ ID NO: 42350
  chr9:139487465-139487495
  Hypo

SEQ ID NO: 131488 - DNA, 114 bp, Homo sapiens
  chr9:139491047-139491161
  Hypo
cccggctgccgtgtgcgggccctgggtaacaaaagtgattgtgtacttgaggaaaggagacggttatgagaaacactccccgttacagcattttacgttcgcagggaaaatgcc

SEQ ID NO: 131489 - DNA, 51 bp, Homo sapiens; identical to SEQ ID NO: 100788
  chr9:139501991-139502042
  Hypo

SEQ ID NO: 131490 - DNA, 30 bp, Homo sapiens; identical to SEQ ID NO: 42351
  chr9:139504374-139504404
  Hypo

SEQ ID NO: 131491 - DNA, 170 bp, Homo sapiens; identical to SEQ ID NO: 100790
  chr9:139504817-139504987
  Hypo

SEQ ID NO: 131492 - DNA, 101 bp, Homo sapiens; identical to SEQ ID NO: 42353
  chr9:139505621-139505722
  Hypo

SEQ ID NO: 131493 - DNA, 76 bp, Homo sapiens; identical to SEQ ID NO: 42354
  chr9:139506440-139506516
  Hypo

SEQ ID NO: 131494 - DNA, 30 bp, Homo sapiens; identical to SEQ ID NO: 42355
  chr9:139517238-139517268
  Hypo

SEQ ID NO: 131495 - DNA, 33 bp, Homo sapiens; identical to SEQ ID NO: 100794
  chr9:139535581-139535614
  Hypo

SEQ ID NO: 131496 - DNA, 151 bp, Homo sapiens; identical to SEQ ID NO: 100795
  chr9:139546454-139546605
  Hypo

SEQ ID NO: 131497 - DNA, 52 bp, Homo sapiens; identical to SEQ ID NO: 100796
  chr9:139560006-139560058
  Hyper

SEQ ID NO: 131498 - DNA, 429 bp, Homo sapiens; identical to SEQ ID NO: 100797
  chr9:139606291-139606720
  Hyper

SEQ ID NO: 131499 - DNA, 336 bp, Homo sapiens; identical to SEQ ID NO: 100798
  chr9:139606963-139607299
  Hyper

SEQ ID NO: 131500 - DNA, 180 bp, Homo sapiens; identical to SEQ ID NO: 100799
  chr9:139634047-139634227
  Hypo

SEQ ID NO: 131501 - DNA, 30 bp, Homo sapiens; identical to SEQ ID NO: 100800
  chr9:139634437-139634467
  Hypo

SEQ ID NO: 131502 - DNA, 195 bp, Homo sapiens; identical to SEQ ID NO: 100801
  chr9:139638343-139638538
  Hypo

SEQ ID NO: 131503 - DNA, 138 bp, Homo sapiens; identical to SEQ ID NO: 42359
  chr9:139654706-139654844
  Hypo

SEQ ID NO: 131504 - DNA, 179 bp, Homo sapiens; identical to SEQ ID NO: 100803
  chr9:139662229-139662408
  Hypo

SEQ ID NO: 131505 - DNA, 595 bp, Homo sapiens; identical to SEQ ID NO: 42361
  chr9:139698658-139699253
  Hypo

SEQ ID NO: 131506 - DNA, 30 bp, Homo sapiens; identical to SEQ ID NO: 100805
  chr9:139701246-139701276
  Hypo

SEQ ID NO: 131507 - DNA, 87 bp, Homo sapiens; identical to SEQ ID NO: 100806
  chr9:139703836-139703923
  Hypo

SEQ ID NO: 131508 - DNA, 387 bp, Homo sapiens; identical to SEQ ID NO: 100807
  chr9:139704043-139704430
  Hypo

SEQ ID NO: 131509 - DNA, 99 bp, Homo sapiens; identical to SEQ ID NO: 42364
  chr9:139705312-139705411
  Hypo

SEQ ID NO: 131510 - DNA, 98 bp, Homo sapiens; identical to SEQ ID NO: 42365
  chr9:139714085-139714183
  Hypo

SEQ ID NO: 131511 - DNA, 333 bp, Homo sapiens; identical to SEQ ID NO: 100810
  chr9:139717731-139718064
  Hypo

SEQ ID NO: 131512 - DNA, 34 bp, Homo sapiens; identical to SEQ ID NO: 100811
  chr9:139721948-139721982
  Hypo

SEQ ID NO: 131513 - DNA, 191 bp, Homo sapiens; identical to SEQ ID NO: 100812
  chr9:139734907-139735098
  Hypo

SEQ ID NO: 131514 - DNA, 36 bp, Homo sapiens; identical to SEQ ID NO: 100813
  chr9:139735532-139735568
  Hypo

SEQ ID NO: 131515 - DNA, 448 bp, Homo sapiens
  chr9:139739053-139739501
  Hyper
ccatggagaccctgccggagccaccgccgccggagtccgctgtgccgcgcgcccggacccgcgaagccgagccacgccgccgcgcccgctccaagagtgcgccccgcgcgcccccgggcctgacgcccgcgcccgcctcgccgccggtgttgccccgccgagggcgggaggcccagcgtgcggcgcgggccgaggcatcgccgcgccgggagcccgcgtacccggcgctccgcgcccttgccaacgagctgcatcccatcaagttgcagccgcagcggggcggccccggccgcgtcgcgcccctgtgcgccgccgcgggccgctgcgcaccgcccgagccacccgcgggtcccgccccccacgtgcgctgccgcctggacatcaagccagacgacgcagtgctccagcacgccacccggggctcgcggtcctgcgggcccaccgaggc

SEQ ID NO: 131516 - DNA, 265 bp, Homo sapiens
  chr9:139740567-139740832
  Hyper
ggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgaggagcccgcggccccgggagaggcggccgacgcgtcccccgaaccca

SEQ ID NO: 131517 - DNA, 379 bp, Homo sapiens
  chr9:139741076-139741455
  Hyper
gcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaaccggcagagtgcttcctgctcagcgtgtccgtggccgtgggacccggcaccgcgccaccggggacaccggccctgcccgcgcccgcgccacgcagccacgggccaacagtgcgcaagttcgccaaggtagcgctggcggccggcagccccgcgcggccgcccccggcg

SEQ ID NO: 131518 - DNA, 96 bp, Homo sapiens; identical to SEQ ID NO: 100818
  chr9:139741718-139741814
  Hyper

SEQ ID NO: 131519 - DNA, 30 bp, Homo sapiens; identical to SEQ ID NO: 100819
  chr9:139752642-139752672
  Hypo

SEQ ID NO: 131520 - DNA, 24 bp, Homo sapiens
  chr9:139761759-139761783
  Hypo
atgaaactgcgtttcaaaaaaaaa

SEQ ID NO: 131521 - DNA, 40 bp, Homo sapiens; identical to SEQ ID NO: 100821
  chr9:139779368-139779408
  Hypo

SEQ ID NO: 131522 - DNA, 30 bp, Homo sapiens; identical to SEQ ID NO: 100822
  chr9:139779692-139779722
  Hypo

SEQ ID NO: 131523 - DNA, 120 bp, Homo sapiens; identical to SEQ ID NO: 100823
  chr9:139782635-139782755
  Hypo

SEQ ID NO: 131524 - DNA, 63 bp, Homo sapiens; identical to SEQ ID NO: 100824
  chr9:139793127-139793190
  Hypo

SEQ ID NO: 131525 - DNA, 104 bp, Homo sapiens; identical to SEQ ID NO: 42369
  chr9:139794879-139794983
  Hypo

SEQ ID NO: 131526 - DNA, 444 bp, Homo sapiens; identical to SEQ ID NO: 100826
  chr9:139809719-139810163
  Hypo

SEQ ID NO: 131527 - DNA, 282 bp, Homo sapiens; identical to SEQ ID NO: 42371
  chr9:139818340-139818622
  Hypo

SEQ ID NO: 131528 - DNA, 206 bp, Homo sapiens; identical to SEQ ID NO: 100828
  chr9:139836762-139836968
  Hypo

SEQ ID NO: 131529 - DNA, 88 bp, Homo sapiens; identical to SEQ ID NO: 100829
  chr9:139856294-139856382
  Hypo

SEQ ID NO: 131530 - DNA, 30 bp, Homo sapiens; identical to SEQ ID NO: 100830
  chr9:139858592-139858622
  Hypo

SEQ ID NO: 131531 - DNA, 227 bp, Homo sapiens; identical to SEQ ID NO: 15294
  chr9:139859041-139859268
  Hypo

SEQ ID NO: 131532 - DNA, 311 bp, Homo sapiens; identical to SEQ ID NO: 100832
  chr9:139872509-139872820
  Hyper

SEQ ID NO: 131533 - DNA, 64 bp, Homo sapiens; identical to SEQ ID NO: 100833
  chr9:139879955-139880019
  Hyper

SEQ ID NO: 131534 - DNA, 30 bp, Homo sapiens
  chr9:139880323-139880353
  Hyper
tagcccaggagggaccgagcctcggctccg

SEQ ID NO: 131535 - DNA, 55 bp, Homo sapiens; identical to SEQ ID NO: 100835
  chr9:139885973-139886028
  Hypo

SEQ ID NO: 131536 - DNA, 30 bp, Homo sapiens; identical to SEQ ID NO: 100836
  chr9:139886617-139886647
  Hyper

SEQ ID NO: 131537 - DNA, 340 bp, Homo sapiens; identical to SEQ ID NO: 100837
  chr9:139888764-139889104
  Hypo

SEQ ID NO: 131538 - DNA, 61 bp, Homo sapiens; identical to SEQ ID NO: 100838
  chr9:139902974-139903035
  Hypo

SEQ ID NO: 131539 - DNA, 295 bp, Homo sapiens; identical to SEQ ID NO: 100839
  chr9:139904237-139904532
  Hypo

SEQ ID NO: 131540 - DNA, 39 bp, Homo sapiens; identical to SEQ ID NO: 100840
  chr9:139913362-139913401
  Hypo

SEQ ID NO: 131541 - DNA, 345 bp, Homo sapiens; identical to SEQ ID NO: 100841
  chr9:139915848-139916193
  Hypo

SEQ ID NO: 131542 - DNA, 154 bp, Homo sapiens; identical to SEQ ID NO: 100842
  chr9:139943348-139943502
  Hyper

SEQ ID NO: 131543 - DNA, 230 bp, Homo sapiens; identical to SEQ ID NO: 100843
  chr9:139948020-139948250
  Hyper

SEQ ID NO: 131544 - DNA, 124 bp, Homo sapiens; identical to SEQ ID NO: 100844
  chr9:139971509-139971633
  Hyper

SEQ ID NO: 131545 - DNA, 119 bp, Homo sapiens; identical to SEQ ID NO: 100845
  chr9:139972624-139972743
  Hyper

SEQ ID NO: 131546 - DNA, 105 bp, Homo sapiens; identical to SEQ ID NO: 100846
  chr9:139978936-139979041
  Hypo

SEQ ID NO: 131547 - DNA, 478 bp, Homo sapiens
  chr9:140024612-140025090
  Hyper
gcccagggcctcacccgggcgcggcgtcgcgggggccgagggaaggaccggaccctcccgaggtcgcggacccggccggctggggcgaggctggggtggcccctaccccgagctaagctggccgcgccgcatctcaccgtcgccggggcccgagcgctgcgcctggaccggcgccgagcgagggggccaagcggccggctggacccacagtccccgcgccataggcgggtcggggctttcagactcggctccagccctcaaacctggtagccttggaggtcagcttgagatgactgcgcttcctgcgcgcgttgtcctccccagaaacgctcaaaatggcaaagcggcgtccgtggccgccggaggcctgtgttctcccctgccgaacctcacgcgcggcccctccctcattttcttctggccaggctgccccctgccccttgggcgattctgctgcgtcccacggtcctggctgtgg

SEQ ID NO: 131548 - DNA, 327 bp, Homo sapiens; identical to SEQ ID NO: 100850
  chr9:140030248-140030575
  Hypo

SEQ ID NO: 131549 - DNA, 103 bp, Homo sapiens; identical to SEQ ID NO: 100851
  chr9:140032848-140032951
  Hyper

SEQ ID NO: 131550 - DNA, 903 bp, Homo sapiens
  chr9:140033279-140034182
  Hyper
acatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgcccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacc

SEQ ID NO: 131551 - DNA, 98 bp, Homo sapiens; identical to SEQ ID NO: 100855
  chr9:140041751-140041849
  Hypo

SEQ ID NO: 131552 - DNA, 132 bp, Homo sapiens; identical to SEQ ID NO: 100856
  chr9:140043219-140043351
  Hypo

SEQ ID NO: 131553 - DNA, 23 bp, Homo sapiens
  chr9:140046638-140046661
  Hypo
tgagccaccgtgcccagccactt

SEQ ID NO: 131554 - DNA, 584 bp, Homo sapiens
  chr9:140050925-140051509
  Hyper
ggtaagagccagcaacggaggcctgggaggctcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcccgtcatccccgtctgccccacagcgaggacgatgctgccactgtataccgcgcagccgcgatgctgaacatgacgggctccgggtacgtgtggctggtcggcgagcgcgagatctcggggaacgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggtgggcggggcctccccgga

SEQ ID NO: 131555 - DNA, 62 bp, Homo sapiens; identical to SEQ ID NO: 100860
  chr9:140052371-140052433
  Hypo

SEQ ID NO: 131556 - DNA, 30 bp, Homo sapiens; identical to SEQ ID NO: 100861
  chr9:140081822-140081852
  Hypo

SEQ ID NO: 131557 - DNA, 30 bp, Homo sapiens; identical to SEQ ID NO: 100862
  chr9:140089410-140089440
  Hypo

SEQ ID NO: 131558 - DNA, 30 bp, Homo sapiens; identical to SEQ ID NO: 100863
  chr9:140090122-140090152
  Hypo

SEQ ID NO: 131559 - DNA, 143 bp, Homo sapiens; identical to SEQ ID NO: 100864
  chr9:140090372-140090515
  Hypo

SEQ ID NO: 131560 - DNA, 627 bp, Homo sapiens; identical to SEQ ID NO: 100865
  chr9:140107109-140107736
  Hypo

SEQ ID NO: 131561 - DNA, 423 bp, Homo sapiens; identical to SEQ ID NO: 100866
  chr9:140108038-140108461
  Hypo

SEQ ID NO: 131562 - DNA, 30 bp, Homo sapiens; identical to SEQ ID NO: 42385
  chr9:140115123-140115153
  Hypo

SEQ ID NO: 131563 - DNA, 186 bp, Homo sapiens; identical to SEQ ID NO: 100868
  chr9:140121048-140121234
  Hypo

SEQ ID NO: 131564 - DNA, 551 bp, Homo sapiens; identical to SEQ ID NO: 100869
  chr9:140127636-140128187
  Hypo

SEQ ID NO: 131565 - DNA, 104 bp, Homo sapiens; identical to SEQ ID NO: 100870
  chr9:140137230-140137334
  Hypo

SEQ ID NO: 131566 - DNA, 120 bp, Homo sapiens; identical to SEQ ID NO: 100871
  chr9:140137634-140137754
  Hypo

SEQ ID NO: 131567 - DNA, 37 bp, Homo sapiens; identical to SEQ ID NO: 100872
  chr9:140140229-140140266
  Hypo

SEQ ID NO: 131568 - DNA, 89 bp, Homo sapiens; identical to SEQ ID NO: 100873
  chr9:140140759-140140848
  Hypo

SEQ ID NO: 131569 - DNA, 124 bp, Homo sapiens; identical to SEQ ID NO: 100874
  chr9:140144101-140144225
  Hypo

SEQ ID NO: 131570 - DNA, 123 bp, Homo sapiens; identical to SEQ ID NO: 100875
  chr9:140147052-140147175
  Hypo

SEQ ID NO: 131571 - DNA, 71 bp, Homo sapiens; identical to SEQ ID NO: 100876
  chr9:140167020-140167091
  Hypo

SEQ ID NO: 131572 - DNA, 30 bp, Homo sapiens; identical to SEQ ID NO: 100877
  chr9:140167383-140167413
  Hypo

SEQ ID NO: 131573 - DNA, 30 bp, Homo sapiens; identical to SEQ ID NO: 100878
  chr9:140196166-140196196
  Hyper

SEQ ID NO: 131574 - DNA, 109 bp, Homo sapiens; identical to SEQ ID NO: 100879
  chr9:140198590-140198699
  Hypo

SEQ ID NO: 131575 - DNA, 193 bp, Homo sapiens; identical to SEQ ID NO: 100880
  chr9:140205428-140205621
  Hypo

SEQ ID NO: 131576 - DNA, 38 bp, Homo sapiens; identical to SEQ ID NO: 100881
  chr9:140208526-140208564
  Hypo

SEQ ID NO: 131577 - DNA, 60 bp, Homo sapiens; identical to SEQ ID NO: 100882
  chr9:140211623-140211683
  Hypo

SEQ ID NO: 131578 - DNA, 30 bp, Homo sapiens; identical to SEQ ID NO: 100883
  chr9:140216230-140216260
  Hypo

SEQ ID NO: 131579 - DNA, 95 bp, Homo sapiens; identical to SEQ ID NO: 100884
  chr9:140243648-140243743
  Hypo

SEQ ID NO: 131580 - DNA, 369 bp, Homo sapiens; identical to SEQ ID NO: 100885
  chr9:140245629-140245998
  Hypo

SEQ ID NO: 131581 - DNA, 30 bp, Homo sapiens; identical to SEQ ID NO: 100886
  chr9:140246519-140246549
  Hypo

SEQ ID NO: 131582 - DNA, 168 bp, Homo sapiens; identical to SEQ ID NO: 100887
  chr9:140265734-140265902
  Hypo

SEQ ID NO: 131583 - DNA, 186 bp, Homo sapiens; identical to SEQ ID NO: 100888
  chr9:140266430-140266616
  Hypo

SEQ ID NO: 131584 - DNA, 73 bp, Homo sapiens; identical to SEQ ID NO: 100889
  chr9:140267262-140267335
  Hypo

SEQ ID NO: 131585 - DNA, 30 bp, Homo sapiens; identical to SEQ ID NO: 100890
  chr9:140267796-140267826
  Hypo

SEQ ID NO: 131586 - DNA, 198 bp, Homo sapiens; identical to SEQ ID NO: 100891
  chr9:140274064-140274262
  Hypo

SEQ ID NO: 131587 - DNA, 46 bp, Homo sapiens; identical to SEQ ID NO: 100892
  chr9:140274616-140274662
  Hypo

SEQ ID NO: 131588 - DNA, 182 bp, Homo sapiens; identical to SEQ ID NO: 100893
  chr9:140325463-140325645
  Hypo

SEQ ID NO: 131589 - DNA, 30 bp, Homo sapiens; identical to SEQ ID NO: 42401
  chr9:140327964-140327994
  Hypo

SEQ ID NO: 131590 - DNA, 646 bp, Homo sapiens; identical to SEQ ID NO: 100895
  chr9:140332500-140333146
  Hypo

SEQ ID NO: 131591 - DNA, 48 bp, Homo sapiens; identical to SEQ ID NO: 42404
  chr9:140352105-140352153
  Hypo

SEQ ID NO: 131592 - DNA, 36 bp, Homo sapiens; identical to SEQ ID NO: 100897
  chr9:140352383-140352419
  Hypo

SEQ ID NO: 131593 - DNA, 30 bp, Homo sapiens; identical to SEQ ID NO: 100898
  chr9:140357584-140357614
  Hypo

SEQ ID NO: 131594 - DNA, 30 bp, Homo sapiens; identical to SEQ ID NO: 100899
  chr9:140379933-140379963
  Hypo

SEQ ID NO: 131595 - DNA, 68 bp, Homo sapiens; identical to SEQ ID NO: 42405
  chr9:140382557-140382625
  Hypo

SEQ ID NO: 131596 - DNA, 30 bp, Homo sapiens; identical to SEQ ID NO: 100901
  chr9:140388971-140389001
  Hypo

SEQ ID NO: 131597 - DNA, 214 bp, Homo sapiens; identical to SEQ ID NO: 100902
  chr9:140389309-140389523
  Hypo

SEQ ID NO: 131598 - DNA, 481 bp, Homo sapiens; identical to SEQ ID NO: 100903
  chr9:140392377-140392858
  Hypo

SEQ ID NO: 131599 - DNA, 88 bp, Homo sapiens; identical to SEQ ID NO: 100904
  chr9:140395491-140395579
  Hypo

SEQ ID NO: 131600 - DNA, 182 bp, Homo sapiens; identical to SEQ ID NO: 100905
  chr9:140396560-140396742
  Hypo

SEQ ID NO: 131601 - DNA, 221 bp, Homo sapiens; identical to SEQ ID NO: 100906
  chr9:140396982-140397203
  Hypo

SEQ ID NO: 131602 - DNA, 261 bp, Homo sapiens; identical to SEQ ID NO: 100907
  chr9:140400208-140400469
  Hypo

SEQ ID NO: 131603 - DNA, 30 bp, Homo sapiens; identical to SEQ ID NO: 100908
  chr9:140400875-140400905
  Hypo

SEQ ID NO: 131604 - DNA, 169 bp, Homo sapiens; identical to SEQ ID NO: 100909
  chr9:140401421-140401590
  Hypo

SEQ ID NO: 131605 - DNA, 27 bp, Homo sapiens
  chr9:140498381-140498408
  Hypo
agccaccgcgcccggtgaaacaccttc

SEQ ID NO: 131606 - DNA, 127 bp, Homo sapiens; identical to SEQ ID NO: 100911
  chr9:140507292-140507419
  Hypo

SEQ ID NO: 131607 - DNA, 74 bp, Homo sapiens; identical to SEQ ID NO: 100912
  chr9:140508476-140508550
  Hypo

SEQ ID NO: 131608 - DNA, 23 bp, Homo sapiens
  chr9:140511850-140511873
  Hypo
accgcacccggcccagtcaacaa

SEQ ID NO: 131609 - DNA, 174 bp, Homo sapiens; identical to SEQ ID NO: 100914
  chr9:140512180-140512354
  Hypo

SEQ ID NO: 131610 - DNA, 19 bp, Homo sapiens
  chr9:140539579-140539598
  Hypo
ctcccgaagtgctgggatt

SEQ ID NO: 131611 - DNA, 30 bp, Homo sapiens; identical to SEQ ID NO: 100916
  chr9:140582852-140582882
  Hypo

SEQ ID NO: 131612 - DNA, 48 bp, Homo sapiens; identical to SEQ ID NO: 100917
  chr9:140615444-140615492
  Hypo

SEQ ID NO: 131613 - DNA, 285 bp, Homo sapiens; identical to SEQ ID NO: 100918
  chr9:140657710-140657995
  Hypo

SEQ ID NO: 131614 - DNA, 30 bp, Homo sapiens; identical to SEQ ID NO: 100919
  chr9:140658538-140658568
  Hypo

SEQ ID NO: 131615 - DNA, 100 bp, Homo sapiens; identical to SEQ ID NO: 100920
  chr9:140664560-140664660
  Hypo

SEQ ID NO: 131616 - DNA, 161 bp, Homo sapiens; identical to SEQ ID NO: 100921
  chr9:140665866-140666027
  Hypo

SEQ ID NO: 131617 - DNA, 45 bp, Homo sapiens; identical to SEQ ID NO: 15313
  chr9:140680320-140680365
  Hypo

SEQ ID NO: 131618 - DNA, 127 bp, Homo sapiens; identical to SEQ ID NO: 100923
  chr9:140682795-140682922
  Hypo

SEQ ID NO: 131619 - DNA, 30 bp, Homo sapiens; identical to SEQ ID NO: 42421
  chr9:140693933-140693963
  Hypo

SEQ ID NO: 131620 - DNA, 390 bp, Homo sapiens; identical to SEQ ID NO: 100925
  chr9:140707510-140707900
  Hypo

SEQ ID NO: 131621 - DNA, 79 bp, Homo sapiens; identical to SEQ ID NO: 100926
  chr9:140708692-140708771
  Hypo

SEQ ID NO: 131622 - DNA, 188 bp, Homo sapiens; identical to SEQ ID NO: 100927
  chr9:140708986-140709174
  Hypo

SEQ ID NO: 131623 - DNA, 30 bp, Homo sapiens; identical to SEQ ID NO: 100928
  chr9:140723495-140723525
  Hypo

SEQ ID NO: 131624 - DNA, 405 bp, Homo sapiens; identical to SEQ ID NO: 100929
  chr9:140727525-140727930
  Hypo

SEQ ID NO: 131625 - DNA, 97 bp, Homo sapiens; identical to SEQ ID NO: 100930
  chr9:140770013-140770110
  Hypo

SEQ ID NO: 131626 - DNA, 278 bp, Homo sapiens; identical to SEQ ID NO: 100931
  chr9:140772069-140772347
  Hyper

SEQ ID NO: 131627 - DNA, 958 bp, Homo sapiens
  chr9:140772557-140773515
  Hyper
tgtacaaccccatcccggtcaagcagaactgcttcaccgtcaaccgctcgctcttcgtcttcagcgaggacaacgtcgtccgcaaatacgcgaagcgcatcaccgagtggccatatcctgccgggcggggccgggcggggccgggcggggaccggggtgggggccggggccggggccatcttcccggtggccgggagggcgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggctccggacccagttgtctcagcccctccggagacggcctagcggtggctgctgcactgggctctgctggcgtcggcctcgtgtttccctccgtgcggcgtctgccggccagtccttaactcacgcactccattcgag

SEQ ID NO: 131628 - DNA, 18 bp, Homo sapiens
  chr9:140793805-140793823
  Hypo
aagcgctgggattgggat

SEQ ID NO: 131629 - DNA, 86 bp, Homo sapiens; identical to SEQ ID NO: 100935
  chr9:140969254-140969340
  Hypo

SEQ ID NO: 131630 - DNA, 177 bp, Homo sapiens; identical to SEQ ID NO: 42427
  chr9:141022582-141022759
  Hypo

SEQ ID NO: 131631 - DNA, 107 bp, Homo sapiens; identical to SEQ ID NO: 100937
  chr9:141044732-141044839
  Hyper

SEQ ID NO: 131632 - DNA, 147 bp, Homo sapiens; identical to SEQ ID NO: 101458
  chrX:2742585-2742732
  Hypo

SEQ ID NO: 131633 - DNA, 83 bp, Homo sapiens; identical to SEQ ID NO: 101459
  chrX:2746913-2746996
  Hyper

SEQ ID NO: 131634 - DNA, 235 bp, Homo sapiens; identical to SEQ ID NO: 101460
  chrX:2747708-2747943
  Hyper

SEQ ID NO: 131635 - DNA, 100 bp, Homo sapiens; identical to SEQ ID NO: 101461
  chrX:2825711-2825811
  Hypo

SEQ ID NO: 131636 - DNA, 30 bp, Homo sapiens; identical to SEQ ID NO: 101462
  chrX:2835934-2835964
  Hypo

SEQ ID NO: 131637 - DNA, 148 bp, Homo sapiens; identical to SEQ ID NO: 101463
  chrX:2836217-2836365
  Hypo

SEQ ID NO: 131638 - DNA, 158 bp, Homo sapiens; identical to SEQ ID NO: 38629
  chrX:2846239-2846397
  Hyper

SEQ ID NO: 131639 - DNA, 49 bp, Homo sapiens; identical to SEQ ID NO: 101465
  chrX:2846807-2846856
  Hyper

SEQ ID NO: 131640 - DNA, 121 bp, Homo sapiens; identical to SEQ ID NO: 101466
  chrX:2847075-2847196
  Hyper

SEQ ID NO: 131641 - DNA, 159 bp, Homo sapiens; identical to SEQ ID NO: 101467
  chrX:2931173-2931332
  Hypo

SEQ ID NO: 131642 - DNA, 30 bp, Homo sapiens; identical to SEQ ID NO: 101468
  chrX:2933263-2933293
  Hypo

SEQ ID NO: 131643 - DNA, 100 bp, Homo sapiens; identical to SEQ ID NO: 101470
  chrX:2945321-2945421
  Hypo

SEQ ID NO: 131644 - DNA, 39 bp, Homo sapiens; identical to SEQ ID NO: 101472
  chrX:3229228-3229267
  Hypo

SEQ ID NO: 131645 - DNA, 814 bp, Homo sapiens
  chrX:3263355-3264169
  Hyper
ggctccgcctctgggcgctggaacaaaccggctcctgcagctctgcaaaagtcctcggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagctaggccgccagagacggtctgcgaaccccgccgggaagcaggggtgggggcgtgaggccgtctgctttcgtcttggccctgggcagacaacctggagtggccgggcgggcagccctgagcccctggccggcttccagagtccgctgggtcgcgtcgagctggctgcgggatgaattacgagctttcccggaacgcggctggggtggccctgcgagtccccgccgcccgggactcggacaccaaaccccttttgtctgcgtgatgactgtcccggtttttttgcatggctcggatcactctaggcgttgggctgtcccctttccagggaaagcctgggtaagagtaggaggaaagaggcggggaaggagagggggaagagaggagggagaggagacttgaagtagccacagcctgagcaacttggaaagaggctcctcaagcgtcctttcccccaccgattgcaagagcag

SEQ ID NO: 131646 - DNA, 596 bp, Homo sapiens
  chrX:3264627-3265223
  Hyper
cggccgggagtttgccggggccatgcccttcccggggccgggggtgaggcagctcggcttcccagcgcggcacagcaagccggcgcccttttattcccggcgctgcgaggcttccccaagtccacgcctcggcacacccccaccctgccccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtccgcgcttggagagcgcctaagcagcgctgggaacgtttccgttcctttcaggagagagagaaggagcagggtttgcgcttctccgggccagacggtgttttctcggcagctcttcccagaccgtgtgcaagcaggagcgggctggccccgccggcatcccactagctgcaggcagggctgcaacgtgagagccgccgccacgccctcccg

SEQ ID NO: 131647 - DNA, 102 bp, Homo sapiens; identical to SEQ ID NO: 101479
  chrX:3478175-3478277
  Hypo

SEQ ID NO: 131648 - DNA, 33 bp, Homo sapiens; identical to SEQ ID NO: 101480
  chrX:3630804-3630837
  Hyper

SEQ ID NO: 131649 - DNA, 40 bp, Homo sapiens; identical to SEQ ID NO: 101481
  chrX:3694581-3694621
  Hypo

SEQ ID NO: 131650 - DNA, 140 bp, Homo sapiens; identical to SEQ ID NO: 101482
  chrX:3746502-3746642
  Hypo

SEQ ID NO: 131651 - DNA, 30 bp, Homo sapiens; identical to SEQ ID NO: 101495
  chrX:4335009-4335039
  Hypo

SEQ ID NO: 131652 - DNA, 32 bp, Homo sapiens; identical to SEQ ID NO: 101502
  chrX:4606598-4606630
  Hypo

SEQ ID NO: 131653 - DNA, 31 bp, Homo sapiens; identical to SEQ ID NO: 101503
  chrX:4606870-4606901
  Hypo

SEQ ID NO: 131654 - DNA, 30 bp, Homo sapiens; identical to SEQ ID NO: 101504
  chrX:4636880-4636910
  Hypo

SEQ ID NO: 131655 - DNA, 196 bp, Homo sapiens; identical to SEQ ID NO: 101505
  chrX:4691958-4692154
  Hypo

SEQ ID NO: 131656 - DNA, 30 bp, Homo sapiens; identical to SEQ ID NO: 46884
  chrX:5757324-5757354
  Hypo

SEQ ID NO: 131657 - DNA, 94 bp, Homo sapiens; identical to SEQ ID NO: 101512
  chrX:6143621-6143715
  Hyper

SEQ ID NO: 131658 - DNA, 514 bp, Homo sapiens; identical to SEQ ID NO: 101513
  chrX:6143775-6144289
  Hyper

SEQ ID NO: 131659 - DNA, 937 bp, Homo sapiens
  chrX:6144913-6145850
  Hyper
tccctacctcatccccgctcgcgcttccgcaggtcaggccacgcgggtgccagcgcgggctgtgggcgccccagccgcggccttggggaggggtcaggactgaagttcactctctctctgcgtggtctcgaagcccctcgcccaccccgcactgtctcctccgccgccggctgcgcgcttggcggatcttctccatcagttctgcccactggagtgggaaggggctgagccgagccgcgcgggaattgggaggcggggaagcggggaggcgggggaagagacgagatgaaatcggcccgggacagcagagaggcttgggatgggatggaagggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcccggagctaccgtcatttcatcttcacgcggggtctccagcgcgcctggatcgttccctagccaagccaagccaggtctaatcaatcacgtgcgttatttcgtgcatcacccaagccgtcatcttatccga

SEQ ID NO: 131660 - DNA, 178 bp, Homo sapiens; identical to SEQ ID NO: 101522
  chrX:7895411-7895589
  Hyper

SEQ ID NO: 131661 - DNA, 719 bp, Homo sapiens
  chrX:8698504-8699223
  Hyper
gccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaagcgcgcgcgcacacacacatactccccaccctcaggctgaaagaacctacgttcggggtttgggggacggttcccccgggactcgttgaggagtatccgaatacggccccgccaaatcccctgtccccggcacttcttccctgacgctctacgctagtccagggca

SEQ ID NO: 131662 - DNA, 314 bp, Homo sapiens; identical to SEQ ID NO: 101525
  chrX:8699436-8699750
  Hyper

SEQ ID NO: 131663 - DNA, 422 bp, Homo sapiens; identical to SEQ ID NO: 101526
  chrX:8700038-8700460
  Hyper

SEQ ID NO: 131664 - DNA, 45 bp, Homo sapiens; identical to SEQ ID NO: 101531
  chrX:9433426-9433471
  Hyper

SEQ ID NO: 131665 - DNA, 126 bp, Homo sapiens; identical to SEQ ID NO: 101532
  chrX:9433712-9433838
  Hyper

SEQ ID NO: 131666 - DNA, 30 bp, Homo sapiens; identical to SEQ ID NO: 46885
  chrX:11773720-11773750
  Hypo

SEQ ID NO: 131667 - DNA, 36 bp, Homo sapiens; identical to SEQ ID NO: 101427
  chrX:12157151-12157187
  Hyper

SEQ ID NO: 131668 - DNA, 30 bp, Homo sapiens; identical to SEQ ID NO: 101429
  chrX:12734830-12734860
  Hypo

SEQ ID NO: 131669 - DNA, 181 bp, Homo sapiens; identical to SEQ ID NO: 101431
  chrX:13707253-13707434
  Hyper

SEQ ID NO: 131670 - DNA, 30 bp, Homo sapiens; identical to SEQ ID NO: 101432
  chrX:13740786-13740816
  Hypo

SEQ ID NO: 131671 - DNA, 1260 bp, Homo sapiens; identical to SEQ ID NO: 101433
  chrX:13955858-13957118
  Hyper

SEQ ID NO: 131672 - DNA, 151 bp, Homo sapiens; identical to SEQ ID NO: 101435
  chrX:14048060-14048211
  Hyper

SEQ ID NO: 131673 - DNA, 102 bp, Homo sapiens; identical to SEQ ID NO: 101440
  chrX:15511442-15511544
  Hyper

SEQ ID NO: 131674 - DNA, 262 bp, Homo sapiens; identical to SEQ ID NO: 101441
  chrX:15756104-15756366
  Hyper

SEQ ID NO: 131675 - DNA, 30 bp, Homo sapiens; identical to SEQ ID NO: 101442
  chrX:16702919-16702949
  Hypo

SEQ ID NO: 131676 - DNA, 718 bp, Homo sapiens
  chrX:16729910-16730628
  Hyper
attctgtagcagcagcgtagttcggcactatgcgccctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtgcgggcgctggcgcgggcggaggcgggaagaagcgcgtcccggggacgcgcgggacaggctccaaccgcactgggcacgggccagcgttccccagtccccgcgccacacccggcagccgaggtctgcgagcgcggggctggcggccggacccgactcagcgctgggcagggagccggcgccatcagagagcggacaaaggagcccggccccacaagtgcaccggggctgggggtgcagggcggagaggccctggggacgagggatggcccgggcgccgaggccctgggggtctgggacaggcccagaagggaagttacctgcgcggtggtggtagcaccggggagggtggccggtgggcacggcgggctccaccccgcggctggcctggcgctcacctgtcgggctggggaaggggtcgctgccggggctgtccaaagccgcccccgggatcttcccaccgcccacacgggcctcggggtgcgcggcgc

SEQ ID NO: 131677 - DNA, 50 bp, Homo sapiens; identical to SEQ ID NO: 101445
  chrX:16730852-16730902
  Hyper

SEQ ID NO: 131678 - DNA, 395 bp, Homo sapiens; identical to SEQ ID NO: 101446
  chrX:16887830-16888225
  Hyper

SEQ ID NO: 131679 - DNA, 112 bp, Homo sapiens; identical to SEQ ID NO: 101447
  chrX:16888552-16888664
  Hyper

SEQ ID NO: 131680 - DNA, 30 bp, Homo sapiens; identical to SEQ ID NO: 101448
  chrX:19353762-19353792
  Hypo

SEQ ID NO: 131681 - DNA, 20 bp, Homo sapiens
  chrX:19435187-19435207
  Hypo
caagatggctgaatacgaac

SEQ ID NO: 131682 - DNA, 35 bp, Homo sapiens; identical to SEQ ID NO: 101450
  chrX:20160936-20160971
  Hypo

SEQ ID NO: 131683 - DNA, 42 bp, Homo sapiens; identical to SEQ ID NO: 101451
  chrX:22973409-22973451
  Hypo

SEQ ID NO: 131684 - DNA, 39 bp, Homo sapiens; identical to SEQ ID NO: 101452
  chrX:23217730-23217769
  Hypo

SEQ ID NO: 131685 - DNA, 35 bp, Homo sapiens; identical to SEQ ID NO: 101453
  chrX:23714117-23714152
  Hypo

SEQ ID NO: 131686 - DNA, 22 bp, Homo sapiens
  chrX:23825274-23825296
  Hypo
gcaagaccgtctcctcccaaaa

SEQ ID NO: 131687 - DNA, 30 bp, Homo sapiens; identical to SEQ ID NO: 101455
  chrX:24074681-24074711
  Hypo

SEQ ID NO: 131688 - DNA, 100 bp, Homo sapiens; identical to SEQ ID NO: 101456
  chrX:25039052-25039152
  Hyper

SEQ ID NO: 131689 - DNA, 173 bp, Homo sapiens; identical to SEQ ID NO: 101457
  chrX:26179543-26179716
  Hypo

SEQ ID NO: 131690 - DNA, 30 bp, Homo sapiens; identical to SEQ ID NO: 101469
  chrX:29374805-29374835
  Hypo

SEQ ID NO: 131691 - DNA, 30 bp, Homo sapiens; identical to SEQ ID NO: 101471
  chrX:30648695-30648725
  Hypo

SEQ ID NO: 131692 - DNA, 122 bp, Homo sapiens; identical to SEQ ID NO: 101477
  chrX:33744448-33744570
  Hyper

SEQ ID NO: 131693 - DNA, 94 bp, Homo sapiens; identical to SEQ ID NO: 101478
  chrX:34149739-34149833
  Hypo

SEQ ID NO: 131694 - DNA, 30 bp, Homo sapiens; identical to SEQ ID NO: 101483
  chrX:39868222-39868252
  Hyper

SEQ ID NO: 131695 - DNA, 30 bp, Homo sapiens; identical to SEQ ID NO: 101484
  chrX:39964600-39964630
  Hyper

SEQ ID NO: 131696 - DNA, 30 bp, Homo sapiens; identical to SEQ ID NO: 101485
  chrX:39968920-39968950
  Hyper

SEQ ID NO: 131697 - DNA, 323 bp, Homo sapiens; identical to SEQ ID NO: 101486
  chrX:40005519-40005842
  Hyper

SEQ ID NO: 131698 - DNA, 30 bp, Homo sapiens; identical to SEQ ID NO: 101487
  chrX:40006116-40006146
  Hyper

SEQ ID NO: 131699 - DNA, 132 bp, Homo sapiens; identical to SEQ ID NO: 101488
  chrX:40014537-40014669
  Hyper

SEQ ID NO: 131700 - DNA, 377 bp, Homo sapiens; identical to SEQ ID NO: 101489
  chrX:40017591-40017968
  Hyper

SEQ ID NO: 131701 - DNA, 44 bp, Homo sapiens
  chrX:40031129-40031173
  Hyper
tgttctgccttaaggcgcgcgggctgatgcgctctctccctcgg

SEQ ID NO: 131702 - DNA, 44 bp, Homo sapiens; identical to SEQ ID NO: 38658
  chrX:40031390-40031434
  Hyper

SEQ ID NO: 131703 - DNA, 632 bp, Homo sapiens; identical to SEQ ID NO: 101491
  chrX:40034425-40035057
  Hyper

SEQ ID NO: 131704 - DNA, 30 bp, Homo sapiens
  chrX:40035724-40035754
  Hyper
agaaaacaaggccggcgactacaagagcgg

SEQ ID NO: 131705 - DNA, 124 bp, Homo sapiens; identical to SEQ ID NO: 101493
  chrX:40126463-40126587
  Hyper

SEQ ID NO: 131706 - DNA, 54 bp, Homo sapiens; identical to SEQ ID NO: 46889
  chrX:41331697-41331751
  Hypo

SEQ ID NO: 131707 - DNA, 22 bp, Homo sapiens
  chrX:44136212-44136234
  Hypo
acttacagctgaggccgggcac

SEQ ID NO: 131708 - DNA, 100 bp, Homo sapiens; identical to SEQ ID NO: 101497
  chrX:44202862-44202962
  Hyper

SEQ ID NO: 131709 - DNA, 163 bp, Homo sapiens; identical to SEQ ID NO: 101498
  chrX:44729844-44730007
  Hypo

SEQ ID NO: 131710 - DNA, 36 bp, Homo sapiens; identical to SEQ ID NO: 101499
  chrX:44751504-44751540
  Hypo

SEQ ID NO: 131711 - DNA, 22 bp, Homo sapiens
  chrX:44755610-44755632
  Hypo
ccgcgcccggccaaaaataaat

SEQ ID NO: 131712 - DNA, 52 bp, Homo sapiens; identical to SEQ ID NO: 46892
  chrX:44922962-44923014
  Hypo

SEQ ID NO: 131713 - DNA, 99 bp, Homo sapiens; identical to SEQ ID NO: 101506
  chrX:47440990-47441089
  Hypo

SEQ ID NO: 131714 - DNA, 30 bp, Homo sapiens; identical to SEQ ID NO: 101507
  chrX:54977452-54977482
  Hypo

SEQ ID NO: 131715 - DNA, 40 bp, Homo sapiens; identical to SEQ ID NO: 46893
  chrX:58297213-58297253
  Hypo

SEQ ID NO: 131716 - DNA, 30 bp, Homo sapiens; identical to SEQ ID NO: 46894
  chrX:58304829-58304859
  Hypo

SEQ ID NO: 131717 - DNA, 124 bp, Homo sapiens; identical to SEQ ID NO: 101511
  chrX:58307150-58307274
  Hypo

SEQ ID NO: 131718 - DNA, 30 bp, Homo sapiens; identical to SEQ ID NO: 101516
  chrX:67871660-67871690
  Hypo

SEQ ID NO: 131719 - DNA, 145 bp, Homo sapiens; identical to SEQ ID NO: 101517
  chrX:69501680-69501825
  Hypo

SEQ ID NO: 131720 - DNA, 155 bp, Homo sapiens; identical to SEQ ID NO: 101518
  chrX:71525843-71525998
  Hyper

SEQ ID NO: 131721 - DNA, 34 bp, Homo sapiens; identical to SEQ ID NO: 101519
  chrX:71526883-71526917
  Hyper

SEQ ID NO: 131722 - DNA, 30 bp, Homo sapiens; identical to SEQ ID NO: 101520
  chrX:73740816-73740846
  Hypo

SEQ ID NO: 131723 - DNA, 38 bp, Homo sapiens; identical to SEQ ID NO: 101521
  chrX:78711045-78711083
  Hypo

SEQ ID NO: 131724 - DNA, 30 bp, Homo sapiens; identical to SEQ ID NO: 101527
  chrX:91035211-91035241
  Hyper

SEQ ID NO: 131725 - DNA, 516 bp, Homo sapiens; identical to SEQ ID NO: 101528
  chrX:91035598-91036114
  Hyper

SEQ ID NO: 131726 - DNA, 221 bp, Homo sapiens; identical to SEQ ID NO: 101529
  chrX:91037061-91037282
  Hyper

SEQ ID NO: 131727 - DNA, 41 bp, Homo sapiens; identical to SEQ ID NO: 101530
  chrX:92928695-92928736
  Hyper

SEQ ID NO: 131728 - DNA, 105 bp, Homo sapiens; identical to SEQ ID NO: 101533
  chrX:97101386-97101491
  Hypo

SEQ ID NO: 131729 - DNA, 101 bp, Homo sapiens; identical to SEQ ID NO: 101534
  chrX:97285055-97285156
  Hypo

SEQ ID NO: 131730 - DNA, 30 bp, Homo sapiens; identical to SEQ ID NO: 101535
  chrX:99924339-99924369
  Hypo

SEQ ID NO: 131731 - DNA, 46 bp, Homo sapiens; identical to SEQ ID NO: 101424
  chrX:103087251-103087297
  Hyper

SEQ ID NO: 131732 - DNA, 199 bp, Homo sapiens; identical to SEQ ID NO: 101425
  chrX:108803671-108803870
  Hypo

SEQ ID NO: 131733 - DNA, 164 bp, Homo sapiens; identical to SEQ ID NO: 101428
  chrX:122924437-122924601
  Hypo

SEQ ID NO: 131734 - DNA, 80 bp, Homo sapiens; identical to SEQ ID NO: 101430
  chrX:136134699-136134779
  Hyper

SEQ ID NO: 131735 - DNA, 34 bp, Homo sapiens
  chrX:136656397-136656431
  Hyper
cccggggctcatcagcgaacgtcctctctcgctc

SEQ ID NO: 131736 - DNA, 94 bp, Homo sapiens; identical to SEQ ID NO: 101434
  chrX:139804733-139804827
  Hypo

SEQ ID NO: 131737 - DNA, 30 bp, Homo sapiens; identical to SEQ ID NO: 101436
  chrX:150560243-150560273
  Hypo

SEQ ID NO: 131738 - DNA, 30 bp, Homo sapiens; identical to SEQ ID NO: 101437
  chrX:150732700-150732730
  Hypo

SEQ ID NO: 131739 - DNA, 30 bp, Homo sapiens; identical to SEQ ID NO: 101438
  chrX:151080838-151080868
  Hypo

SEQ ID NO: 131740 - DNA, 30 bp, Homo sapiens; identical to SEQ ID NO: 101439
  chrX:151088584-151088614
  Hypo

SEQ ID NO: 131741 - DNA, 67 bp, Homo sapiens; identical to SEQ ID NO: 101545
  chrY:4869647-4869714
  Hyper

SEQ ID NO: 131742 - DNA, 210 bp, Homo sapiens; identical to SEQ ID NO: 101546
  chrY:6778824-6779034
  Hyper

SEQ ID NO: 131743 - DNA, 30 bp, Homo sapiens; identical to SEQ ID NO: 101547
  chrY:6779293-6779323
  Hyper

SEQ ID NO: 131744 - DNA, 61 bp, Homo sapiens; identical to SEQ ID NO: 101548
  chrY:6779746-6779807
  Hyper

SEQ ID NO: 131745 - DNA, 20 bp, Homo sapiens
  chrY:14301600-14301620
  Hypo
gagcgacacagaagacgggt

SEQ ID NO: 131746 - DNA, 57 bp, Homo sapiens; identical to SEQ ID NO: 101537
  chrY:14567906-14567963
  Hypo

SEQ ID NO: 131747 - DNA, 30 bp, Homo sapiens; identical to SEQ ID NO: 46899
  chrY:14621298-14621328
  Hypo

SEQ ID NO: 131748 - DNA, 243 bp, Homo sapiens; identical to SEQ ID NO: 101539
  chrY:16635817-16636060
  Hyper

SEQ ID NO: 131749 - DNA, 89 bp, Homo sapiens; identical to SEQ ID NO: 101540
  chrY:21728053-21728142
  Hypo

SEQ ID NO: 131750 - DNA, 116 bp, Homo sapiens; identical to SEQ ID NO: 101541
  chrY:22901316-22901432
  Hypo

SEQ ID NO: 131751 - DNA, 159 bp, Homo sapiens; identical to SEQ ID NO: 101542
  chrY:22918423-22918582
  Hypo

SEQ ID NO: 131752 - DNA, 94 bp, Homo sapiens; identical to SEQ ID NO: 101543
  chrY:23111711-23111805
  Hypo

SEQ ID NO: 131753 - DNA, 30 bp, Homo sapiens; identical to SEQ ID NO: 101544
  chrY:23613703-23613733
  Hypo

SEQ ID NO: 131754 - DNA, 40 bp, Homo sapiens; identical to SEQ ID NO: 101549
  CR856017.2_11887-39781:16677-16717
  Hypo

SEQ ID NO: 131755 - DNA, 32 bp, Homo sapiens; identical to SEQ ID NO: 101550
  CR936360.14_69981-85448:11336-11368
  Hypo

SEQ ID NO: 131756 - DNA, 30 bp, Homo sapiens; identical to SEQ ID NO: 46912
  FP565324.3_2001-29640:15187-15217
  Hypo

SEQ ID NO: 131757 - DNA, 30 bp, Homo sapiens; identical to SEQ ID NO: 101552
  FP565324.3_2001-29640:19444-19474
  Hypo

SEQ ID NO: 131758 - DNA, 124 bp, Homo sapiens; identical to SEQ ID NO: 101553
  FP565324.3_2001-29640:19686-19810
  Hypo

SEQ ID NO: 131759 - DNA, 30 bp, Homo sapiens; identical to SEQ ID NO: 101554
  FP565324.3_2001-29640:25504-25534
  Hypo

SEQ ID NO: 131760 - DNA, 264 bp, Homo sapiens; identical to SEQ ID NO: 101555
  GL000220.1:138909-139173
  Hypo

SEQ ID NO: 131761 - DNA, 160 bp, Homo sapiens; identical to SEQ ID NO: 101556
  GL000258.1:893139-893299
  Hyper

SEQ ID NO: 131762 - DNA, 30 bp, Homo sapiens; identical to SEQ ID NO: 101557
  GL383548.1:10245-10275
  Hypo

SEQ ID NO: 131763 - DNA, 82 bp, Homo sapiens; identical to SEQ ID NO: 14151
  JH159140.1:144237-144319
  Hyper

SEQ ID NO: 131764 - DNA, 184 bp, Homo sapiens; identical to SEQ ID NO: 101559
  JH636052.4:1361645-1361829
  Hyper

SEQ ID NO: 131765 - DNA, 24 bp, Homo sapiens
  JH636052.4:1362108-1362132
  Hyper
gacttgctcctacagcgcgggaaa

SEQ ID NO: 131766 - DNA, 24 bp, Homo sapiens
  JH636052.4:1362192-1362216
  Hyper
tgatgtcaccgacagtgcctttcc

SEQ ID NO: 131767 - DNA, 30 bp, Homo sapiens; identical to SEQ ID NO: 101562
  JH636052.4:1370528-1370558
  Hypo

SEQ ID NO: 131768 - DNA, 18 bp, Homo sapiens
  JH636052.4:2022610-2022628
  Hypo
aacaataaaacaggccgg

SEQ ID NO: 131769 - DNA, 29 bp, Homo sapiens
  JH636052.4:2254977-2255006
  Hypo
ccaccgcgcccggccggtttaccattttt

SEQ ID NO: 131770 - DNA, 32 bp, Homo sapiens; identical to SEQ ID NO: 101565
  JH636052.4:2269647-2269679
  Hyper

SEQ ID NO: 131771 - DNA, 36 bp, Homo sapiens; identical to SEQ ID NO: 101566
  JH636052.4:2280989-2281025
  Hyper

SEQ ID NO: 131772 - DNA, 89 bp, Homo sapiens; identical to SEQ ID NO: 101567
  JH636052.4:2302679-2302768
  Hyper

SEQ ID NO: 131773 - DNA, 211 bp, Homo sapiens; identical to SEQ ID NO: 38684
  JH636052.4:5118718-5118929
  Hyper

SEQ ID NO: 131774 - DNA, 225 bp, Homo sapiens; identical to SEQ ID NO: 101569
  JH636058.1:413166-413391
  Hyper

SEQ ID NO: 131775 - DNA, 30 bp, Homo sapiens; identical to SEQ ID NO: 101573
  NW_001838014.1_249000-295694:441-471
  Hypo

SEQ ID NO: 131776 - DNA, 61 bp, Homo sapiens; identical to SEQ ID NO: 46915
  NW_001838014.1_249000-295694:3702-3763
  Hypo

SEQ ID NO: 131777 - DNA, 191 bp, Homo sapiens; identical to SEQ ID NO: 101572
  NW_001838014.1_249000-295694:4069-4260
  Hypo

SEQ ID NO: 131778 - DNA, 284 bp, Homo sapiens; identical to SEQ ID NO: 101574
  NW_001838014.1_249000-295694:7106-7390
  Hypo

SEQ ID NO: 131779 - DNA, 445 bp, Homo sapiens; identical to SEQ ID NO: 101570
  NW_001838014.1_249000-295694:13512-13957
  Hypo

SEQ ID NO: 131780 - DNA, 36 bp, Homo sapiens; identical to SEQ ID NO: 101575
  NW_001838016.1_818233-828058:5545-5581
  Hypo

SEQ ID NO: 131781 - DNA, 30 bp, Homo sapiens; identical to SEQ ID NO: 101576
  NW_001838016.1_818233-828058:6037-6067
  Hypo

SEQ ID NO: 131782 - DNA, 30 bp, Homo sapiens; identical to SEQ ID NO: 101577
  NW_001838016.1_818233-828058:6848-6878
  Hypo

SEQ ID NO: 131783 - DNA, 32 bp, Homo sapiens; identical to SEQ ID NO: 101578
  NW_001838016.1_818233-828058:7308-7340
  Hypo

SEQ ID NO: 131784 - DNA, 166 bp, Homo sapiens; identical to SEQ ID NO: 101579
  NW_001838016.1_818233-828058:7554-7720
  Hypo

SEQ ID NO: 131785 - DNA, 81 bp, Homo sapiens; identical to SEQ ID NO: 101580
  NW_001838056.1_145425-224902:38739-38820
  Hypo

SEQ ID NO: 131786 - DNA, 140 bp, Homo sapiens; identical to SEQ ID NO: 101581
  NW_001838056.1_145425-224902:42669-42809
  Hypo

SEQ ID NO: 131787 - DNA, 30 bp, Homo sapiens; identical to SEQ ID NO: 101582
  NW_001838194.1_126783-128006:853-883
  Hypo

SEQ ID NO: 131788 - DNA, 274 bp, Homo sapiens; identical to SEQ ID NO: 101583
  NW_001838403.1_1-2251:78-352
  Hyper

SEQ ID NO: 131789 - DNA, 70 bp, Homo sapiens; identical to SEQ ID NO: 101584
  NW_001838877.2_33615069-33616110:636-706
  Hypo

SEQ ID NO: 131790 - DNA, 24 bp, Homo sapiens
  NW_001839407.1_42766-49957:1190-1214
  Hypo
tcgccggcccgctggtgcctctgc

SEQ ID NO: 131791 - DNA, 30 bp, Homo sapiens; identical to SEQ ID NO: 101587
  NW_001839407.1_56047-63507:754-784
  Hypo

SEQ ID NO: 131792 - DNA, 39 bp, Homo sapiens; identical to SEQ ID NO: 101586
  NW_001839407.1_56047-63507:7039-7078
  Hypo

SEQ ID NO: 131793 - DNA, 77 bp, Homo sapiens; identical to SEQ ID NO: 101588
  NW_001839455.1_124947-137693:9386-9463
  Hypo

SEQ ID NO: 131794 - DNA, 140 bp, Homo sapiens; identical to SEQ ID NO: 101589
  NW_001839455.1_50266-109797:44348-44488
  Hypo

SEQ ID NO: 131795 - DNA, 30 bp, Homo sapiens; identical to SEQ ID NO: 101590
  NW_001839603.1_36678-41438:2681-2711
  Hypo

SEQ ID NO: 131796 - DNA, 39 bp, Homo sapiens; identical to SEQ ID NO: 101591
  NW_001839609.1_1-3470:1119-1158
  Hypo

SEQ ID NO: 131797 - DNA, 75 bp, Homo sapiens; identical to SEQ ID NO: 101592
  NW_001839668.1_21493-58548:15519-15594
  Hypo

SEQ ID NO: 131798 - DNA, 90 bp, Homo sapiens; identical to SEQ ID NO: 46922
  NW_001839760.1_243903-260476:6752-6842
  Hypo

SEQ ID NO: 131799 - DNA, 64 bp, Homo sapiens; identical to SEQ ID NO: 101594
  NW_001840246.1_7363-10559:45-109
  Hypo

SEQ ID NO: 131800 - DNA, 32 bp, Homo sapiens; identical to SEQ ID NO: 101595
  NW_001840306.1_6328-82586:11021-11053
  Hypo

SEQ ID NO: 131801 - DNA, 178 bp, Homo sapiens; identical to SEQ ID NO: 101596
  NW_001840306.1_6328-82586:33514-33692
  Hypo

SEQ ID NO: 131802 - DNA, 29 bp, Homo sapiens
  NW_001840646.1_6803-11069:2056-2085
  Hypo
ccttccggaggagccgtggaggcataggc

SEQ ID NO: 131803 - DNA, 77 bp, Homo sapiens; identical to SEQ ID NO: 101598
  NW_001840700.1_1-4272:2301-2378
  Hypo

SEQ ID NO: 131804 - DNA, 16 bp, Homo sapiens
  NW_001840754.1_117-3691:2521-2537
  Hypo
ccgcagggagggtgcc

SEQ ID NO: 131805 - DNA, 30 bp, Homo sapiens; identical to SEQ ID NO: 46924
  NW_001840841.1_1-4205:1669-1699
  Hypo

SEQ ID NO: 131806 - DNA, 187 bp, Homo sapiens; identical to SEQ ID NO: 101601
  NW_001840866.1_38854-140524:80412-80599
  Hypo

SEQ ID NO: 131807 - DNA, 30 bp, Homo sapiens; identical to SEQ ID NO: 101602
  NW_001840954.1_1-14936:6819-6849
  Hypo

SEQ ID NO: 131808 - DNA, 23 bp, Homo sapiens
  NW_001841011.1_96346-168555:36552-36575
  Hypo
ggggggaacgagtgacctttcca

SEQ ID NO: 131809 - DNA, 36 bp, Homo sapiens; identical to SEQ ID NO: 101604
  NW_001841011.1_96346-168555:37241-37277
  Hypo

SEQ ID NO: 131810 - DNA, 120 bp, Homo sapiens; identical to SEQ ID NO: 101605
  NW_001841051.1_40144-46142:4764-4884
  Hypo

SEQ ID NO: 131811 - DNA, 78 bp, Homo sapiens; identical to SEQ ID NO: 101606
  NW_001841110.1_111-11841:9020-9098
  Hypo

SEQ ID NO: 131812 - DNA, 37 bp, Homo sapiens; identical to SEQ ID NO: 101607
  NW_001841138.1_665891-688550:14581-14618
  Hypo

SEQ ID NO: 131813 - DNA, 18 bp, Homo sapiens
  NW_001841138.1_67124-102688:26293-26311
  Hypo
ggccgtgcaacaaacaaa

SEQ ID NO: 131814 - DNA, 137 bp, Homo sapiens; identical to SEQ ID NO: 101609
  NW_001841138.1_67124-102688:27763-27900
  Hypo

SEQ ID NO: 131815 - DNA, 55 bp, Homo sapiens; identical to SEQ ID NO: 46928
  NW_001841145.1_177495-186900:5222-5277
  Hypo

SEQ ID NO: 131816 - DNA, 37 bp, Homo sapiens; identical to SEQ ID NO: 101611
  NW_001841145.1_177495-186900:6312-6349
  Hypo

SEQ ID NO: 131817 - DNA, 25 bp, Homo sapiens
  NW_001841145.1_68487-74424:228-253
  Hypo
ctccacacagcggagaggtgccgtt

SEQ ID NO: 131818 - DNA, 39 bp, Homo sapiens; identical to SEQ ID NO: 101613
  NW_001841157.1_1611084-1612812:1051-1090
  Hypo

SEQ ID NO: 131819 - DNA, 20 bp, Homo sapiens
  NW_001841160.1_117611-172877:34909-34929
  Hypo
gtaatcgaatggaataaata

SEQ ID NO: 131820 - DNA, 69 bp, Homo sapiens; identical to SEQ ID NO: 46929
  NW_001842432.1_1-179261:101291-101360
  Hypo

SEQ ID NO: 131821 - DNA, 95 bp, Homo sapiens; identical to SEQ ID NO: 101616
  NW_001842432.1_1-179261:103119-103214
  Hypo

SEQ ID NO: 131822 - DNA, 157 bp, Homo sapiens; identical to SEQ ID NO: 101617
  NW_001842432.1_1-179261:113208-113365
  Hypo
